(12) United States Patent
Bernett et al.

(10) Patent No.: US 10,981,992 B2
(45) Date of Patent: Apr. 20, 2021

(54) BISPECIFIC IMMUNOMODULATORY ANTIBODIES THAT BIND COSTIMULATORY AND CHECKPOINT RECEPTORS

(71) Applicant: Xencor, Inc., Monrovia, CA (US)

(72) Inventors: Matthew Bernett, Monrovia, CA (US); Gregory Moore, Azusa, CA (US); John Desjarlais, Pasadena, CA (US); Michael Hedvat, Encino, CA (US); Christine Bonzon, Los Angeles, CA (US)

(73) Assignee: Xencor, Inc., Monrovia, CA (US)

( * ) Notice: Subject to any disclaimer, the term of this patent is extended or adjusted under 35 U.S.C. 154(b) by 246 days.

(21) Appl. No.: 16/184,929

(22) Filed: Nov. 8, 2018

(65) Prior Publication Data

US 2019/0270816 A1 Sep. 5, 2019

Related U.S. Application Data

(60) Provisional application No. 62/583,431, filed on Nov. 8, 2017, provisional application No. 62/614,271, filed on Jan. 5, 2018, provisional application No. 62/640,468, filed on Mar. 8, 2018, provisional application No. 62/683,554, filed on Jun. 11, 2018, provisional application No. 62/724,502, filed on Aug. 29, 2018.

(51) Int. Cl.
| C07K 16/28 | (2006.01) |
| A61K 39/395 | (2006.01) |
| A61P 35/00 | (2006.01) |
| A61P 37/06 | (2006.01) |
| A61K 39/00 | (2006.01) |

(52) U.S. Cl.
CPC .......... C07K 16/2818 (2013.01); A61P 35/00 (2018.01); A61P 37/06 (2018.01); C07K 16/2803 (2013.01); C07K 16/2827 (2013.01); A61K 2039/505 (2013.01); A61K 2039/507 (2013.01); C07K 2317/31 (2013.01); C07K 2317/33 (2013.01); C07K 2317/52 (2013.01); C07K 2317/55 (2013.01); C07K 2317/622 (2013.01); C07K 2317/64 (2013.01); C07K 2317/76 (2013.01); C07K 2317/92 (2013.01)

(58) Field of Classification Search
None
See application file for complete search history.

(56) References Cited

U.S. PATENT DOCUMENTS

| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |

(Continued)

FOREIGN PATENT DOCUMENTS

| EP | 0425235 B1 | 9/1996 |
| EP | 1752471 | 2/2007 |

(Continued)

OTHER PUBLICATIONS

U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.

(Continued)

*Primary Examiner* — Ilia I Ouspenski
(74) *Attorney, Agent, or Firm* — Louis-Vu T. Nguyen; Robin M. Silva; Morgan, Lewis & Bockius, LLP

(57) ABSTRACT

The present invention is directed to bispecific, heterodimeric immunomodulatory antibodies.

6 Claims, 295 Drawing Sheets

Specification includes a Sequence Listing.

(56) References Cited

U.S. PATENT DOCUMENTS

| | | |
|---|---|---|
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | MacK et al. |
| 6,803,039 B2 * | 10/2004 | Tsuji ............... A61P 29/00 424/144.1 |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 10,793,632 B2 * | 10/2020 | Bernett ............ C07K 16/2809 |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |

(56) References Cited

U.S. PATENT DOCUMENTS

| | | |
|---|---|---|
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2018/0118828 A1 | 5/2018 | Bernett et al. |
| 2018/0127501 A1* | 5/2018 | Bernett .............. C07K 16/2809 |
| 2019/0263909 A1* | 8/2019 | Bernett ............ A61K 39/39541 |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |

(56) References Cited

FOREIGN PATENT DOCUMENTS

| WO | WO2010151808 | 12/2010 |
|---|---|---|
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2019050521 | 3/2019 |

OTHER PUBLICATIONS

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

Abbott Laboratories, Strategies and Current Approaches for Improving Drug-Like-Properties During Biologics Drug Candidate Selection, AAPS Webinar—Nov. 10, 2011.

Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.

Alberola-Ila et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., Preparation, properties, and applications of carbohydrate conjugates of proteins and lipids, 1981, CRC Crit. Rev. Biochem., pp. 259-306.

Arnett, et al., Crystal structure of a human CD3-$\epsilon/\delta$ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91.3809-3813.

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

(56) References Cited

OTHER PUBLICATIONS

Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol., 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization Of Therapeutic Proteins By T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J. Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly

(56) References Cited

OTHER PUBLICATIONS impacted by linker design, mAbs3:5, 1-8; Sep.-Oct.; 3(5):487-94, Landes Bioscience, Sep. 1, 2011.
DiGiandomenico et al., A multifuncitonal bispecific antibody protects against Pseudomonas aeruginosa., Sci Transl Med. Nov. 12, 2014;6(262):262ra155.doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina, Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.

Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRllb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$-Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.

(56) References Cited

OTHER PUBLICATIONS

Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconjugates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al. Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.

(56) References Cited

OTHER PUBLICATIONS

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No. 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins $O_1^I$ effectively suppress growth and dissemination of liver metastases in a syngeneic model of murine neuroblastoma, 1998, Cancer Res. 58:2928.

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127, doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011,135-149.

(56) References Cited

OTHER PUBLICATIONS

Metz, et al., Bispecifc antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44, pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., the T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (-)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.

(56) References Cited

OTHER PUBLICATIONS

Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-31.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure, 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.

Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-84.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRlll and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al, Oxidatively modified high density lipoprotein promotes inflammatory response in human monocytes-macrophages by enhanced production of ROS, TNF-α, MMP-9, and

(56) References Cited

OTHER PUBLICATIONS

MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell—Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble $\alpha\beta$ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fc$\gamma$ Receptor llb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.

(56) References Cited

OTHER PUBLICATIONS

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wigginton et al., An immunoglobulin E-reactive chimeric human immunoglobulin G1 anti-idiotype inhibits basophil degranulation through cross-linking of FcεRl with FcγRllb., Clinical & Experimental Allergy, 38: 313-319.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zalevsky et al. "Enhanced antibody half-life improves in vivo activity." Nature Biotechnology, vol. 28, No. 2, Feb. 1, 2010, pp. 157-159.

Zamyatnin AA., Amino acid, peptide, and protein volume in solution., *Annu. Rev Biophys Bioeng*. 1984;13:145-65.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zeibig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Zhang et al., The development of bispecific antibodies and their applications in tumor immune escape., Experimental Hematology & Oncology20176:12.

Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.

Fos et al., ICOS ligation recruits the p50alpha PI3K regulatory subunit to the immunological synapse., J Immunol. Aug. 1, 2008;181(3):1969-77.

Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol.2015.05.014. Epub Jun. 11, 2015.

Vieira et al., ICOS-mediated signaling regulates cytokine production by human T cells and provides a unique signal to selectively control the clonal expansion of Th2 helper cells., Eur J Immunol. May 2004;34(5):1282-90.

(56) References Cited

OTHER PUBLICATIONS

Madrenas et al., Conversion of CTLA-4 from inhibitor to activator of T cells with a bispecific tandem single-chain Fv ligand., J Immunol. May 15, 2004;172(10):5948-56.

Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.

Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.

Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.

Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.

Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.

Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.

Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.

U.S. Appl. No. 12/875,015, 2011-0054151, U.S. Pat. No. 9,493,578, Granted, filed Sep. 2, 2010, Mar. 3, 2011, Nov. 15, 2016.

U.S. Appl. No. 15/279,266, 2017-0058053, Abandoned, filed Sep. 28, 2016, Mar. 2, 2017.

U.S. Appl. No. 16/539,986, Pending, filed Aug. 13, 2019.

U.S. Appl. No. 13/648,951, 2013-0171095, Published, filed Oct. 10, 2012, Jul. 4, 2013.

U.S. Appl. No. 13/194,904, 2012-0028304, U.S. Pat. No. 8,637,641, Granted, filed Jul. 29, 2011, Feb. 2, 2012, Jan. 28, 2014.

U.S. Appl. No. 14/165,487, 2014-0249297, U.S. Pat. No. 9,605,061, Granted, filed Jan. 27, 2014, Sep. 4, 2014, Mar. 28, 2017.

U.S. Appl. No. 15/444,087, 2017-0174757, To Be Aband, filed Feb. 27, 2017, Jun. 22, 2017.

U.S. Appl. No. 13/568,028, Abandoned, filed Aug. 6, 2012.

U.S. Appl. No. 14/853,622, 2016-0068588, Published, filed Sep. 14, 2015, Mar. 10, 2016.

U.S. Appl. No. 13/887,234, Abandoned, filed May 3, 2013.

U.S. Appl. No. 14/156,431, 2014-0212435, Abandoned, filed Jan. 15, 2014, Jul. 31, 2014.

U.S. Appl. No. 14/156,432, 2014-0212436, U.S. Pat. No. 9,738,722, Granted, filed Jan. 15, 2014, Jul. 31, 2014, Aug. 22, 2017.

U.S. Appl. No. 14/808,826, 2016-0060360, Abandoned, filed Jul. 24, 2015, Mar. 3, 2016.

U.S. Appl. No. 15/682,380, 2018-0201686, Abandoned, filed Aug. 21, 2017, Jul. 19, 2018.

U.S. Appl. No. 14/155,248, 2014-0322217, Allowed, filed Jan. 4, 2014, Oct. 30, 2014.

U.S. Appl. No. 14/155,334, 2014-0370013, Published, filed Jan. 14, 2014, Dec. 18, 2014.

U.S. Appl. No. 14/155,344, 2014-0294833, U.S. Pat. No. 9,701,759, Granted, filed Jan. 14, 2014, Oct. 2, 2014, Jul. 11, 2017.

U.S. Appl. No. 14/205,227, 2014-0294835, Abandoned, filed Mar. 11, 2014, Oct. 2, 2014.

U.S. Appl. No. 14/205,248, 2014-0288275, U.S. Pat. No. 9,650,446, Granted, filed Mar. 11, 2014, Sep. 25, 2014, May 16, 2017.

U.S. Appl. No. 15/589,908, 2018-0142040, Published, filed May 8, 2017, May 24, 2018.

U.S. Appl. No. 15/633,629, 2018-0215834, Allowed, filed Jun. 26, 2017, Aug. 2, 2018.

U.S. Appl. No. 14/214,418, 2014-0356381, U.S. Pat. No. 10,106,624, Granted, filed Mar. 14, 2014, Dec. 4, 2014, Oct. 23, 2018.

U.S. Appl. No. 16/137,389, Abandoned, filed Sep. 20, 2018.

U.S. Appl. No. 14/214,475, 2014-0294836, Allowed, filed Mar. 14, 2014, Oct 2, 2014.

U.S. Appl. No. 14/217,166, 2014-0294759, Allowed, filed Mar. 17, 2014, Oct. 2, 2014.

U.S. Appl. No. 14/200,652, 2014-0302064, Published, filed Mar. 7, 2014, Oct. 9, 2014.

U.S. Appl. No. 14/207,489, 2014-0377270, U.S. Pat. No. 10,131,710, Granted, filed Mar. 12, 2014, Dec. 25, 2014, Nov. 20, 2018.

U.S. Appl. No. 16/162,172, 2019-0270810, Published, filed Oct. 16, 2018, Sep. 5, 2019.

U.S. Appl. No. 14/200,821, 2014-0294823, U.S. Pat. No. 9,605,084, Granted, filed Mar. 7, 2014, Oct. 2, 2014, Mar. 28, 2017.

U.S. Appl. No. 14/216,705, 2014-0363426, Published, filed Mar. 17, 2014, Dec. 11, 2014.

U.S. Appl. No. 15/444,026, 2018-0037668, U.S. Pat. No. 10,287,364, Granted, Feb. 27, 2017, Feb. 8, 2018, May 14, 2019.

U.S. Appl. No. 16/364,093, Pending, filed Mar. 25, 2019.

U.S. Appl. No. 14/673,695, 2015-0307629, Transferred, filed Mar. 30, 2015, Oct. 29, 2015.

U.S. Appl. No. 15/786,252, 2018-0094079, Published, filed Oct. 17, 2017, Apr. 5, 2018.

U.S. Appl. No. 14/952,705, 2016-0176969, Abandoned, filed Nov. 25, 2015, Jun. 23, 2016.

U.S. Appl. No. 14/952,714, 2016-0229924, Published, filed Nov. 25, 2015, Aug. 11, 2016.

U.S. Appl. No. 15/141,350, 2016-0355608, U.S. Pat. No. 10,259,887, Granted, Apr. 28, 2016, Dec. 8, 2016, Apr. 16, 2019.

U.S. Appl. No. 15/945,679, 2018-0282432, Published, filed Apr. 4, 2018, Oct. 4, 2018.

U.S. Appl. No. 15/945,681, 2018-0223000, Published, filed Apr. 4, 2018, Aug. 9, 2018.

U.S. Appl. No. 16/354,058, 2019-0202938, Published, filed Mar. 14, 2019, Jul. 4, 2019.

U.S. Appl. No. 14/952,786, 2016-0215063, Transferred, filed Nov. 25, 2015, Jul. 28, 2016.

U.S. Appl. No. 15/779,325, Pending, filed May 25, 2018.

U.S. Appl. No. 14/757,809, 2016-0355600, U.S. Pat. No. 10,428,155, Allowed, filed Dec. 22, 2015, Dec. 8, 2016, Oct. 1, 2019.

U.S. Appl. No. 16/530,946, Pending, filed Aug. 2, 2019.

U.S. Appl. No. 15/063,441, 2017-0037131, U.S. Pat. No. 10,227,411, Granted, Mar. 7, 2016, Feb. 9, 2017, Mar. 12, 2019.

U.S. Appl. No. 16/297,255, 2019-0194325, Published, filed Mar. 8, 2019, Jun. 27, 2019.

U.S. Appl. No. 15/372,360, 2017-0320947, U.S. Pat. No. 10,227,410, Granted, filed Dec. 7, 2016, Nov. 9, 2017, Mar. 12, 2019.

U.S. Appl. No. 16/489,539, Pending, filed Aug. 28, 2019.

U.S. Appl. No. 15/623,314, 2018-0118836, Published, filed Jun. 14, 2017, May 3, 2018.

U.S. Appl. No. 16/435,373, Pending, filed Jun. 7, 2019.

U.S. Appl. No. 16/435,375, Pending, filed Jun. 7, 2019.

U.S. Appl. No. 15/611,361, 2017-0349660, Published, filed Jun. 1, 2017, Dec. 7, 2017.

U.S. Appl. No. 15/611,683, 2017-0349657, Published, filed Jun. 1, 2017, Dec. 7, 2017.

U.S. Appl. No. 15/636,590, 2018-0118827, U.S. Pat. No. 10,316,088, Granted, filed Jun. 28, 2017, May 3, 2018, Jun. 11, 2019.

U.S. Appl. No. 16/393,900, 2019-0248898, Published, filed Apr. 24, 2019, Aug. 15, 2019.

U.S. Appl. No. 15/185,958, 2017-0081420, U.S. Pat. No. 9,850,320, Granted, filed Jun. 17, 2016, Mar. 23, 2017, Dec. 26, 2017.

U.S. Appl. No. 15/186,167, 2017-0081424, U.S. Pat. No. 9,856,327, Granted, filed Jun. 17, 2016, Mar. 23, 2017, Jan. 2, 2018.

U.S. Appl. No. 15/691,665, 2018-0127501, Published, filed Aug. 30, 2017, May 10, 2018.

U.S. Appl. No. 16/184,895, 2019-0263909, Published, filed Nov. 8, 2018, Aug. 29, 2019.

(56) References Cited

OTHER PUBLICATIONS

U.S. Appl. No. 16/184,929, 2019-0270816, Published, filed Nov. 8, 2018, Sep. 5, 2019.
U.S. Appl. No. 16/375,777, Pending, filed Apr. 4, 2019.

* cited by examiner

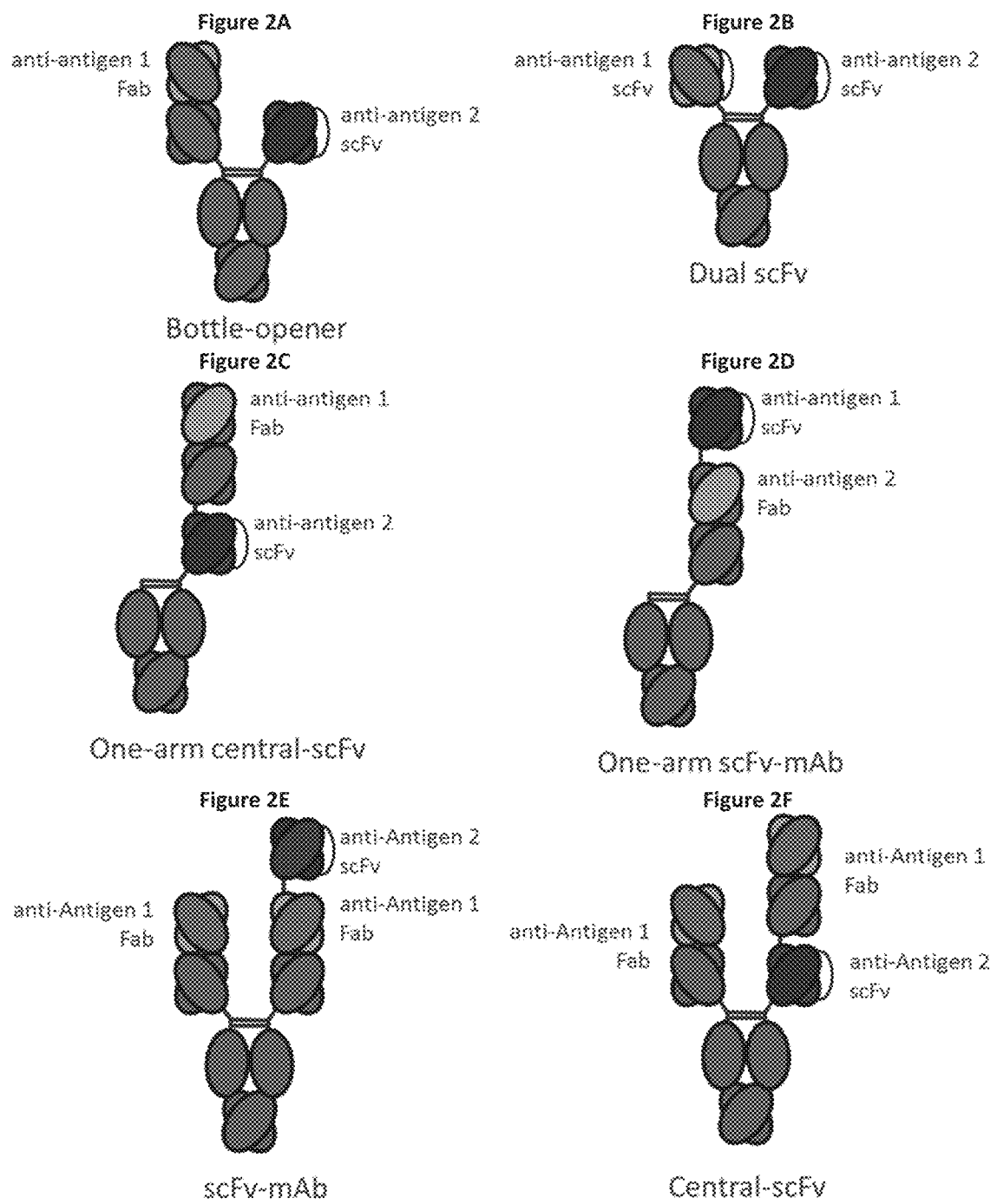

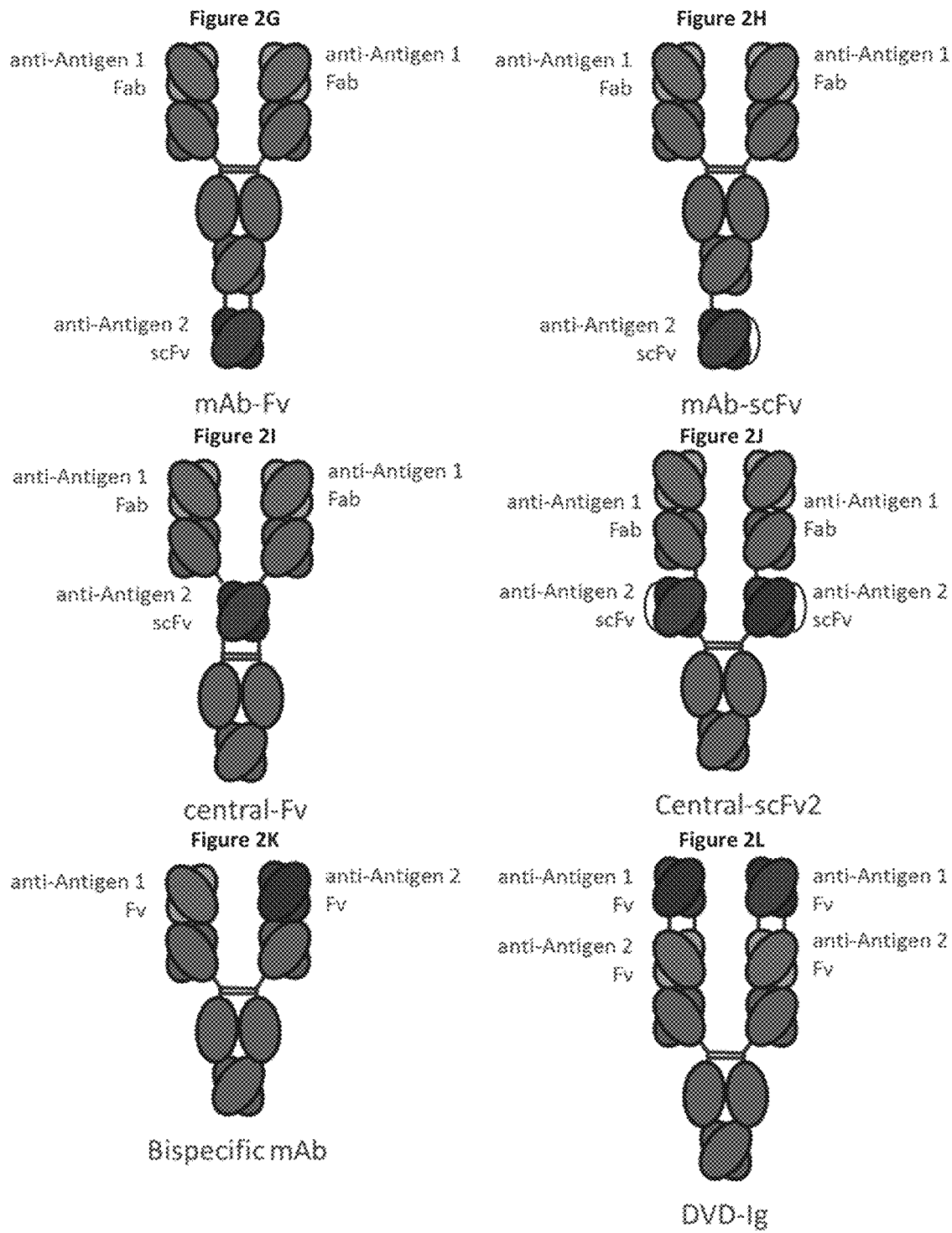

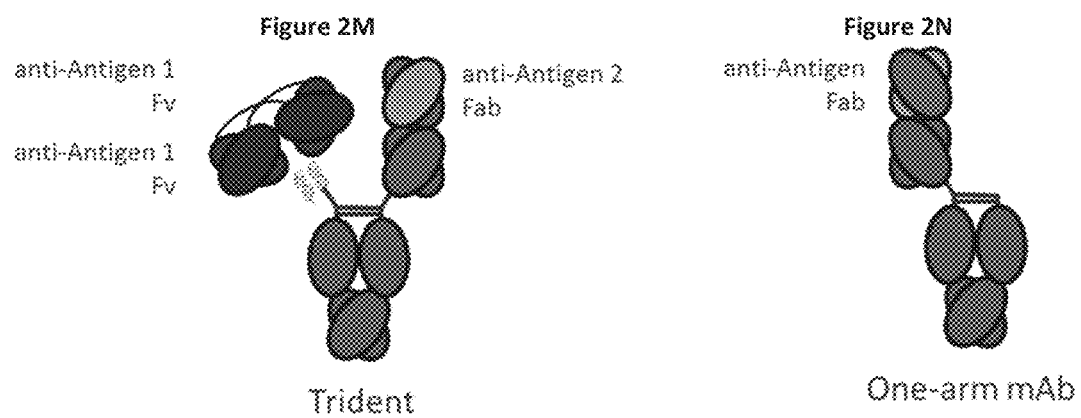

Figure 3A

>XENP023104 [ICOS]_H0.66_L0_Fab-IGG_L1.194_H1.279

| What | sequence | SEQ ID NO: |
|---|---|---|
| VH domain (Fab side) | QVQLVQSGAEVKKPGASVKVSCKASGYTFTGYYMHWVRQAPGQGLEWMGWINPHSGETIYAQKFQGRVTMTR DTSISTAYMELSSLRSEDTAVYYCARTYYDTSGYYHDAFDVWGQGTMVTVSS | 26643 |
| vhCDR1 (Fab side) | GYYMH | 26644 |
| vhCDR2 (Fab side) | WINPHSGETIYAQKFQG | 26645 |
| vhCDR3 (Fab side) | TYYDTSGYYHDAFDV | 26646 |
| VL domain (Fab side) | DIQMTQSPSSVSASVGDRVTITCRASQGISRLLAWYQQKPGKAPKLLIYVASSLQSGVPSRFSGSGSGTDFTLTISSLQ PEDFATYYCQQANSFPWTFGQGTKVEIK | 26658 |
| vlCDR1 (Fab side) | RASQGISRLLA | 26659 |
| vlCDR2 (fab side) | VASSLQS | 26660 |
| vlCDR3 (Fab side) | QQANSFPWT | 26661 |
| Full length Fab HC | QVQLVQSGAEVKKPGASVKVSCKASGYTFTGYYMHWVRQAPGQGLEWMGWINPHSGETIYAQKFQGRVTMTR DTSISTAYMELSSLRSEDTAVYYCARTYYDTSGYYHDAFDVWGQGTMVTVSSASTKGPSVFPLAPSSKSTSGGTAA LGCLVKDYFPEPVTVSWNSGALTSGVHTFPAVLQSSGLYSLSSVVTVPSSSLGTQTYICNVNHKPSDTKVDKKVEPKS CDKTHTCPPCPAPPVAGPSVFLFPPKPKDTLMISRTPEVTCVVVDVSHEDPEVKFNWYVDGVEVHNAKTKPREEEY NSTYRVVSVLTVLHQDWLNGKEYKCKVSNKALPAPIEKTISKAKGQPREPQVYTLPPSREEMTKNQVSLTCDVSGFYP SDIAVEWESDGQPENNYKTTPPVLDSDGSFFLYSKLTVDKSRWEQQGDVFSCSVLHEALHSHYTQKSLSLSPGK | 26642 |
| Full length Fab LC | DIQMTQSPSSVSASVGDRVTITCRASQGISRLLAWYQQKPGKAPKLLIYVASSLQSGVPSRFSGSGSGTDFTLTISSLQ PEDFATYYCQQANSFPWTFGQGTKVEIK/RTVAAPSVFIFPPSDEQLKSGTASVVCLLNNFYPREAKVQWKVDNALQ SGNSQESVTEQDSKDSTYSLSSTLTLSKADYEKHKVYACEVTHQGLSSPVTKSFNRGEC | 26657 |

Figure 3B

| What | sequence | SEQ ID NO: |
|---|---|---|
| VH domain (scFv side) | EIVLTQSPATLSASPGERVTLTCRASQSVGNDVAWYQQKPGQAPRLLINYASHRYTGVPDRFTGSGYGTEFTLTISSV QSEDFGVYYCQQDFSSPRTFGGGTKVEIK | 26648 |
| vhCDR1 (scFv) | RASQSVGNDVA | 26651 |
| vhCDR2 (scFv) | YASHRYT | 26652 |
| vhCDR3 (scFv) | QQDFSSPRT | 26653 |
| VL domain (scFv side) | EVQLVESGGGLVKPGGSLRLSCVASGFTFSNYWMNWVRQAPGKGLEWVAEIRLYSNNYATHYAESVKGRFTISRD DSKSTLYLQMNNLKTEDTGVYYCTRYYGNYGGYFDVWGRGTLVTVSS | 26649 |
| vlCDR1 (scFv) | NYWMN | 26654 |
| vlCDR2 (scFv) | EIRLYSNNYATHYAESVKG | 26655 |
| vlCDR3 (scFv) | YYGNYGGYFDV | 26656 |
| scFv chain | EIVLTQSPATLSASPGERVTLTCRASQSVGNDVAWYQQKPGQAPRLLINYASHRYTGVPDRFTGSGYGTEFTLTISSV QSEDFGVYYCQQDFSSPRTFGGGTKVEIK/GKPGSGKPGSGKPGSGKPGS/EVQLVESGGGLVKPGGSLRLSCVASG FTFSNYWMNWVRQAPGKGLEWVAEIRLYSNNYATHYAESVKGRFTISRDDSKSTLYLQMNNLKTEDTGVYYCTRYY GNYGGYFDVWGRGTLVTVSS | |
| Full length scFv HC | EIVLTQSPATLSASPGERVTLTCRASQSVGNDVAWYQQKPGQAPRLLINYASHRYTGVPDRFTGSGYGTEFTLTISSV QSEDFGVYYCQQDFSSPRTFGGGTKVEIK/GKPGSGKPGSGKPGSGKPGS/EVQLVESGGGLVKPGGSLRLSCVASG FTFSNYWMNWVRQAPGKGLEWVAEIRLYSNNYATHYAESVKGRFTISRDDSKSTLYLQMNNLKTEDTGVYYCTRYY GNYGGYFDVWGRGTLVTVSS/EPKSSDKTHTCPPCPAPPVAGPSVFLFPPKPKDTLMISRTPEVTCVVVDVSHEDPE VKFNWYVDGVEVHNAKTKPREEQYNSTYRVVSVLTVLHQDWLNGKEYKCKVSNKALPAPIEKTISKAKGQPREPQV YTLPPSREQMTKNQVKLTCLVKGFYPSDIAVEWESNGQPENNYKTTPPVLDSDGSFFLYSKLTVDKSRWQQGNVFS CSVLHEALHSHYTQKSLSLSPGK | 26647 |

Figure 4A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 4B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 4C

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

Figure 4D

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 4E

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |

Figure 4F

| Monomer 1 | Monomer 2 |
|---|---|
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

Figure 5

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric_A-Fc only | Q295E N384D Q418E N421D |
| pI_(-)_isosteric_B | N208D Q295E Q418E N421D |
| pI_(-)_isosteric_B-Fc only | Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

Figure 6
Ablation variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

Figure 7A useful combinations

| scFv monomer (+) | Fab monomer (-) |
|---|---|
| Heterodimer pI variants S364K/E357Q | Heterodimerization pI variants L368D/K370S |
| Optional scFv charged linker including but not limited to (GKPGS)$_4$ (SEQ ID NO: 26209) | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| scFv of ABD of either ICOS or a checkpoint inhibitor | Fv/Fab of the other of ABD of either ICOS or a checkpoint inhibitor |

Figure 7B

| scFv monomer | Fab monomer |
|---|---|
| Heterodimer pI variants S364K/E357Q | Heterodimerization pI variants L368D/K370S |
| Optional scFv charged linker including, but not limited to (GKPGS)$_4$ (SEQ ID NO: 26209) | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| scFv of either ICOS or a checkpoint inhibitor | Fv/Fab of the other of ABD of either ICOS or a checkpoint inhibitor |

Figure 8A

Positive charged scFv linkers

| Name | Sequence | Length | Charge | SEQ ID NO: |
|---|---|---|---|---|
| Gly-Ser 15 | GGGGSGGGGSGGGGS | 15 | 0 | 26200 |
| Whitlow linker | GSTSGSGKPGSGEGSTKG | 18 | +1 | 26201 |
| 6paxA_1 (+A) | IRPRAIGGSKPRVA | 14 | +4 | 26202 |
| +B | GKGGSGKGGSGKGGS | 15 | +3 | 26203 |
| +C | GGKGSGGKGSGGKGS | 15 | +3 | 26204 |
| +D | GGGKSGGGKSGGGKS | 15 | +3 | 26205 |
| +E | GKGKSGKGKSGKGKS | 15 | +6 | 26206 |
| +F | GGGKSGGKGSGKGGS | 15 | +3 | 26207 |
| +G | GKPGSGKPGSGKPGS | 15 | +3 | 26208 |
| +H | GKPGSGKPGSGKPGSGKPGS | 20 | +4 | 26209 |
| +I | GKGKSGKGKSGKGKSGKGKS | 20 | +8 | 26210 |

Negative charged scFv linkers

| Name | Sequence | Length | Charge | SEQ ID NO: |
|---|---|---|---|---|
| Gly-Ser 15 | GGGGSGGGGSGGGGSGGGGS | 20 | 0 | 26211 |
| 3hsc_2 (-A) | STAGDTHLGGEDFD | 14 | -4 | 26212 |
| -B | GEGGSGEGGSGEGGS | 15 | -3 | 26213 |
| -C | GGEGSGGEGSGGEGS | 15 | -3 | 26214 |
| -D | GGGESGGGESGGGES | 15 | -3 | 26215 |
| -E | GEGESGEGESGEGES | 15 | -6 | 26216 |
| -F | GGGESGGEGSGEGGS | 15 | -3 | 26217 |
| -G | GEGESGEGESGEGESGEGES | 20 | -8 | 26218 |

Figure 8B scFv Linkers

| Sequence | SEQ ID |
|---|---|
| GGGGSGGGGSGGGGS | (SEQ ID NO:26219) |
| GGGGSGGGGSGGGGSGGGGS | (SEQ ID NO:26220) |
| GSTSGSGKPGSGEGSTKG | (SEQ ID NO:26221) |
| PRGASKSGSASQTGSAPGS | (SEQ ID NO:26222) |
| GTAAAGAGAAGGAAAGAAG | (SEQ ID NO:26223) |
| GTSGSSGSGSGGSGSGGGG | (SEQ ID NO:26224) |
| GKPGSGKPGSGKPGSGKPGS | (SEQ ID NO:26225) |

Figure 9A

Bottle opener backbone 1

Fab side heavy chain (SEQ ID NO: 28669)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK scFv heavy chain (SEQ ID NO: 28670)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK constant light chain (SEQ ID NO: 28671)

RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Bottle opener backbone 2

Fab side heavy chain (SEQ ID NO: 28672)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK scFv heavy chain (SEQ ID NO: 28673)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 9B

Bottle opener backbone 3

```
Fab side heavy chain (SEQ ID NO: 28674)
```

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCEVSGFYPSDIAVEWESDGQPENNYKTTPPVLDSDGSFFLYSKLTVDKSRWEQGDVFSCS
VMHEALHNHYTQKSLSLSPGK

```
scFv heavy chain (SEQ ID NO: 28675)
```

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Bottle opener backbone 4

```
Fab side heavy chain (SEQ ID NO: 28676)
```

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTENEVSLTCLVKSGFYPSDIAVEWESDGQPENNYKTTPPVLDSDGSFFLYSKLEVDKSRWEQGDVFSC
SVMHEALHNHYTQKSLSLSPGK

```
scFv heavy chain (SEQ ID NO: 28677)
```

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSKGSFFLYSKLTVDKSRWQQGNVFSCSVMHEALHNHYTQKSLSLSPGK

Bottle opener backbone 5 (356D/358L allotype)

```
Fab side heavy chain (SEQ ID NO: 28678)
```

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSRDELTKNQVSLTCDVSGFYPSDIAVEWESDGQPENNYKTTPPVLDSDGSFFLYSKLTVDKSRWEQGDVFSCS
VMHEALHNHYTQKSLSLSPGK

```
scFv heavy chain (SEQ ID NO: 28679)
```

EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 9C

Bottle opener backbone 6

```
Fab side heavy chain (SEQ ID NO: 28680)
```

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

```
scFv heavy chain (SEQ ID NO: 28681)
```

EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Bottle opener backbone 7

```
Fab side heavy chain (SEQ ID NO: 28682)
```

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

```
scFv heavy chain (SEQ ID NO: 28683)
```

EPKSSDKTHTCPPCPAPPVAGPSVFLFPPKPKDTLMISRTPEVTCVVVDVKHEDPEVKFNWYVDGVEVHNAKTKPRE
EQYSSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Bottle opener backbone 8

```
Fab side heavy chain (SEQ ID NO: 28684)
```

ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPPCPAPEFLGGPSVFLFPPKPKDTLMISRTPEVTCVVVDVKQEDPEVQ
FNWYVDGVEVHNAKTKPREEEFNSTYRVVSVLTVLHQDWLNGKEYKCKVSNKGLPSSIEKTISKAKGQPREPQVYTL
PPSQEEMTKNQVSLTCDVSGFYPSDIAVEWESDGQPENNYKTTPPVLDSDGSFFLYSKLTVDKSRWEEGDVFSCSVM
HEALHNHYTQKSLSLSLGK

```
scFv heavy chain (SEQ ID NO: 28685)
```

ESKYGPPCPPCPAPEFLGGPSVFLFPPKPKDTLMISRTPEVTCVVVDVKQEDPEVQFNWYVDGVEVHNAKTKPREEQ
FNSTYRVVSVLTVLHQDWLNGKEYKCKVSNKGLPSSIEKTISKAKGQPREPQVYTLPPSQEQMTKNQVKLTCLVKGF
YPSDIAVEWESNGQPENNYKTTPPVLDSDGSFFLYSKLTVDKSRWQEGNVFSCSVMHEALHNHYTQKSLSLSLGK

Figure 9D

Bottle opener backbone 9

Fab side heavy chain (SEQ ID NO: 28686)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVSHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK scFv heavy chain (SEQ ID NO: 28687)

ERKCSVECPPCPAPPVAGPSVFLFPPKPKDTLMISRTPEVTCVVVDVSHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

Bottle opener backbone 10

Fab side heavy chain (SEQ ID NO: 28688)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVKHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK scFv heavy chain (SEQ ID NO: 28689)

ERKCSVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

Figure 10A

XENP016432 Nivolumab_H0L0_IgG1_PVA_/S267K

| What | sequence | SEQ ID NO: |
|---|---|---|
| Variable heavy (vh) domain | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS | 28690 |
| vhCDR1 | NSGMH | 28691 |
| vhCDR2 | VIWYDGSKRYYADSVKG | 28692 |
| vhCDR3 | NDDY | 28693 |
| Full length HC | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 28694 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK | 28695 |
| vlCDR1 | RASQSVSSYLA | 28696 |
| vlCDR2 | DASNRAT | 28697 |
| vlCDR3 | QQSSNWPRT | 28698 |
| Full length light chain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 28699 |

Figure 10B

XENP024120 LOPD180[PD-1]_H1L1_IgG1_PVA_/S267K

| What | Sequence | SEQ ID NO: |
|---|---|---|
| Variable heavy (vh) domain | QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDIWGRGTLVTVSS | 28700 |
| vhCDR1 | SGAYYWS | 28701 |
| vhCDR2 | YIYYNGNTYYNPSLRS | 28702 |
| vhCDR3 | ASDYVWGGYHYFDAFDI | 28703 |
| Full length HC | QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDIWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 28704 |
| Variable light (vl) domain | QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL | 28705 |
| vlCDR1 | SGSNSNIGSNSVN | 28706 |
| vlCDR2 | GNNQRPS | 28707 |
| vlCDR3 | AAWDDSLNGPV | 28708 |
| Full length light chain | QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL/GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 28709 |

Figure 10C

XENP024121 mAb7(1.2)[PD-1]_H1L1_IgG1_PVA_/S267K

| What | sequence | SEQ ID NO: |
|---|---|---|
| Variable heavy (vh) domain | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVST | 28710 |
| vhCDR1 | TYWMH | 28711 |
| vhCDR2 | EIDPSDSYVNYNQNFKG | 28712 |
| vhCDR3 | SPDYYGTSLAWFDY | 28713 |
| Full length HC | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVST/ASTKGPSVFPLAPSSKSTSGGTAALGCLVKDYFPEPVTVSWNSGALTSGVHT FPAVLQSSGLYSLSSVVTVPSSSLGTQTYICNVNHKPSDTKVDKKVEPKSCDKTHTCPPCPAPPVAGPSVFLFPPKPKDTLMISRTPEVTC VVVDVKHEDPEVKFNWYVDGVEVHNAKTKPREEEYNSTYRVVSVLTVLHQDWLNGKEYKCKVSNKALPAPIEKTISKAKGQPREPQVY TLPPSREEMTKNQVSLTCDVSGFYPSDIAVEWESDGQPENNYKTTPPVLDSDGSFFLYSKLTVDKSRWEQGDVFSCSVMHEALHNHYT QKSLSLSPGK | 28714 |
| Variable light (vl) domain | EIVLTQSPATLSLSPGERATLSCRASESVDNYGMSFMNWFQQKPGQPPKLLIHAASNQGSGVPSRFSGSGSGTDFTLTISSLEPEDFAVY FCQQSKEVPYTFGGGTKVEIK | 28715 |
| vlCDR1 | RASESVDNYGMSFMN | 28716 |
| vlCDR2 | AASNQGS | 28717 |
| vlCDR3 | QQSKEVPYT | 28718 |
| Full length light chain | EIVLTQSPATLSLSPGERATLSCRASESVDNYGMSFMNWFQQKPGQPPKLLIHAASNQGSGVPSRFSGSGSGTDFTLTISSLEPEDFAVY FCQQSKEVPYTFGGGTKVEIK/RTVAAPSVFIFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC | 28719 |

Figure 10D

XENP019686 1G6_H1.279_L1.194_IgG1_PVA_/S267K

| What | sequence | SEQ ID NO: |
|---|---|---|
| Variable heavy (vh) domain | EVQLVESGGGLVKPGGSLRLSCVASGFTFSNYWMNWVRQAPGKGLEWVAEIRLYSNNYATHYAESVKGRFTISRDDSKSTLYLQMNN LKTEDTGVYYCTRYYGNYGGYFDVWGRGTLVTVSS | 28720 |
| vhCDR1 | NYWMN | 28721 |
| vhCDR2 | EIRLYSNNYATHYAESVKG | 28722 |
| vhCDR3 | YYGNYGGYFDV | 28723 |
| Full length HC | EVQLVESGGGLVKPGGSLRLSCVASGFTFSNYWMNWVRQAPGKGLEWVAEIRLYSNNYATHYAESVKGRFTISRDDSKSTLYLQMNN LKTEDTGVYYCTRYYGNYGGYFDVWGRGTLVTVSS/ASTKGPSVFPLAPSSKSTSGGTAALGCLVKDYFPEPVTVSWNSGALTSGVHTF PAVLQSSGLYSLSSVVTVPSSSLGTQTYICNVNHKPSNTKVDKRVEPKSCDKTHTCPPCPAPPVAGPSVFLFPPKPKDTLMISRTPEVTCV VVDVKHEDPEVKFNWYVDGVEVHNAKTKPREEQYNSTYRVVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVMHEALHNHY TQKSLSLSPGK | 28724 |
| Variable light (vl) domain | EIVLTQSPATLSASPGERVTLTCRASQSVGNDVAWYQQKPGQAPRLLINYASHRYTGVPDRFTGSGYGTEFTLTISSVQSEDFGVYYCQ QDFSSPRTFGGGTKVEIK | 28725 |
| vlCDR1 | RASQSVGNDVA | 28726 |
| vlCDR2 | YASHRYT | 28727 |
| vlCDR3 | QQDFSSPRT | 28728 |
| Full length light chain | EIVLTQSPATLSASPGERVTLTCRASQSVGNDVAWYQQKPGQAPRLLINYASHRYTGVPDRFTGSGYGTEFTLTISSVQSEDFGVYYCQ QDFSSPRTFGGGTKVEIK/RTVAAPSVFIFPPSDEQLKSGTASVVCLLNNFYPREAKVQWKVDNALQSGNSQESVTEQDSKDSTYSLSST LTLSKADYEKHKVYACEVTHQGLSSPVTKSFNRGEC | 28729 |

Figure 10E

XENP020156 2E9_H1L1_IgG1_PVA_/S267K

| What | sequence | SEQ ID NO: |
|---|---|---|
| Variable heavy (vh) domain | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS | 28730 |
| vhCDR1 | NYWLG | 28731 |
| vhCDR2 | NFYPGSSNTYYNEKFQG | 28732 |
| vhCDR3 | HYGTNYRYFDV | 28733 |
| Full length HC | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 28734 |
| Variable light (vl) domain | DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK | 28735 |
| vlCDR1 | RASQSVSNDVA | 28736 |
| vlCDR2 | YASNRYT | 28737 |
| vlCDR3 | QQDYSSPYT | 28738 |
| Full length light chain | DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 28739 |

Figure 11A XENP19690 1G6_H1.279_L1.194 anti-PD-1 Fv sequences

| What | sequence | SEQ ID NO: |
|---|---|---|
| Vh domain | EVQLVESGGGLVKPGGSLRLSCVASGFTFSNYWMNWVRQAPGKGLEWVAEIRLYSNNYATHYAESVKGRFTISRDDSKSTLYLQMN NLKTEDTGVYYCTRYIGNYGGYFDVWGRGTLVTVSS | 28740 |
| vhCDR1 | NYWMN | 28741 |
| vhCDR2 | EIRLYSNNYATHYAESVKG | 28742 |
| vhCDR3 | YIGNYGGYFDV | 28743 |
| scFv linker | GKPGSGKPGSGKPGSGKPGS | 28744 |
| Vl domain | EIVLTQSPATLSASPGERVTLTCRASQSVGNDVAWYQQKPGQAPRLLINYASHRYTGVPDRFTGSGYGTEFTLTISSVQSEDFGVY YCQDFSSPRTFGGGTKVEIK | 28745 |
| vlCDR1 | RASQSVGNDVA | 28746 |
| vlCDR2 | YASHRYT | 28747 |
| vlCDR3 | QDFSSPRT | 28748 |
| scFv | EVQLVESGGGLVKPGGSLRLSCVASGFTFSNYWMNWVRQAPGKGLEWVAEIRLYSNNYATHYAESVKGRFTISRDDSKSTLYLQMN NLKTEDTGVYYCTRYIGNYGGYFDVWGRGTLVTVSS/GKPGSGKPGSGKPGSGKPGS/EIVLTQSPATLSASPGERVTLTCRASQS VGNDVAWYQQKPGQAPRLLINYASHRYTGVPDRFTGSGYGTEFTLTISSVQSEDFGVYYCQDFSSPRTFGGGTKVEIK/ | 28749 |

Figure 11B 1G6_H1.280_L1.224 anti-PD-1 Fv sequences

| What | sequence | SEQ ID NO: |
|---|---|---|
| Variable heavy (vh) domain | EVQLVESGGGLVKPGGSLRLTCVASGFTFSNYWMNWVRQAPGKGLEWVAEIRLYSNNYATHYAESVKGRFTISRDDSKSTLYLQMN NLKTEDTGVYYCTRYIGNYGGYFDVWGRGTLVTVSS | 28750 |
| vhCDR1 | NYWMN | 28751 |
| vhCDR2 | EIRLYSNNYATHYAESVKG | 28752 |
| vhCDR3 | YIGNYGGYFDV | 28753 |
| scFv linker | GKPGSGKPGSGKPGSGKPGS | 28754 |
| Variable light (vl) domain | EIVLTQSPATLSVSPGERVTLTCRASQSVGNDVAWYQQKPGQAPRLLINYASHRYTSVPDRFTGSGYGTEFTLTISSVQSEDFAVY YCQDWSSPRTFGGGTKVEIK | 28755 |
| vlCDR1 | RASQSVGNDVA | 28756 |
| vlCDR2 | YASHRYT | 28757 |
| vlCDR3 | QDWSSPRT | 28758 |
| scFv | EVQLVESGGGLVKPGGSLRLTCVASGFTFSNYWMNWVRQAPGKGLEWVAEIRLYSNNYATHYAESVKGRFTISRDDSKSTLYLQMN NLKTEDTGVYYCTRYIGNYGGYFDVWGRGTLVTVSS/GKPGSGKPGSGKPGSGKPGS/EIVLTQSPATLSVSPGERVTLTCRASQS VGNDVAWYQQKPGQAPRLLINYASHRYTSVPDRFTGSGYGTEFTLTISSVQSEDFAVYYCQDWSSPRTFGGGTKVEIK | 28759 |

Figure 11C XENP19692 1G6_L1.194_H1.279 anti-PD-1 Fv sequences

| What | sequence | SEQ ID NO: |
|---|---|---|
| Variable heavy (vh) domain | EIVLTQSPATLSASPGERVTLTCRASQSVGNDVAWYQQKPGQAPRLLINYASRRYTGVPDRFTGSGYGTEFTLTISSVQSEDFGVY YCQQDFSSPRTFGGGTKVEIK | 28760 |
| vhCDR1 | RASQSVGNDVA | 28761 |
| vhCDR2 | YASRRYT | 28762 |
| vhCDR3 | QQDFSSPRT | 28763 |
| scFv linker | GKPGSGKPGSGKPGSGKPGS | 28764 |
| Variable light (vl) domain | EVQLVESGGGIVKPGGSLRLSCVASGFTFSNYWMNWVRQAPGKGLEWVAEIRLYSNRYATHYAESVKGRFTISRDDSKSTLYLQMN NLKTEDTGVYYCTRYYGNYGGYFDVWGRGTLVTVSS | 28765 |
| vlCDR1 | NYWMN | 28766 |
| vlCDR2 | EIRLYSNRYATHYAESVKG | 28767 |
| vlCDR3 | YYGNYGGYFDV | 28768 |
| scFv | EIVLTQSPATLSASPGERVTLTCRASQSVGNDVAWYQQKPGQAPRLLINYASRRYTGVPDRFTGSGYGTEFTLTISSVQSEDFGVY YCQQDFSSPRTFGGGTKVEIK/GKPGSGKPGSGKPGSGKPGS/EVQLVESGGGIVKPGGSLRLSCVASGFTFSNYWMNWVRQAPGK GLEWVAEIRLYSNRYATHYAESVKGRFTISRDDSKSTLYLQMNNLKTEDTGVYYCTRYYGNYGGYFDVWGRGTLVTVSS | 28769 |

Figure 11D XENP19669 1G6_L1.210_H1.288 anti-PD-1 Fv sequences

| What | sequence | SEQ ID NO: |
|---|---|---|
| Variable heavy (vh) domain | EIVLTQSPATLSASPGERVTLTCRASQSVGNRYAWYQQKPGQAPRLLINYASRRYTGVPDRFGCGTNVEIK | 28770 |
| vhCDR1 | RASQSVGNDVA | 28771 |
| vhCDR2 | YASRRYT | 28772 |
| vhCDR3 | QQDFSGPRT | 28773 |
| scFv linker | GKPGSGKFGSGKPGSGKFGS | 28774 |
| Variable light (vl) domain | EVQLVESGGGIVKPGGSLRLSCVASGFTFSNYWMNWVRQAPGKCLEWVAEIRLYSNRYATHYAESVKGRFTISRDDSKSTLYLQMN NLKTEDTGVYYCTRYYGNYGGYFDV | 28775 |
| vlCDR1 | NYWMN | 28776 |
| vlCDR2 | EIRLYSNRYATHYAESVKG | 28777 |
| vlCDR3 | YYGNYGGYFDV | 28778 |
| scFv | EIVLTQSPATLSASPGERVTLTCRASQSVGNRYAWYQQKPGQAPRLLINYASRRYTGVPDRFTGSGYGTEFTLTISSVQSEDFGVY YCQQDFSGPRTFGCGTNVEIK/GKPGSGKFGSGKPGSGKFGS/EVQLVESGGGIVKPGGSLRLSCVASGFTFSNYWMNWVRQAPGK CLEWVAEIRLYSNRYATHYAESVKGRFTISRDDSKSTLYLQMNNLKTEDTGVYYCTRYYGNYGGYFDVWGRGTLVTVSS | 28779 |

Figure 11E XENP20162 2E9_H1L1 anti-PD-1 Fv sequences

| What | sequence | SEQ ID NO: |
|---|---|---|
| Variable heavy (vh) domain | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS | 28780 |
| vhCDR1 | NYWLG | 28781 |
| vhCDR2 | NFYPGSSNTYYNEKFQG | 28782 |
| vhCDR3 | HYGTNYRYFDV | 28783 |
| scFv linker | GKPGSGKPGSGKPGSGKPGS | 28784 |
| Variable light (vl) domain | DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK | 28785 |
| vlCDR1 | RASQSVSNDVA | 28786 |
| vlCDR2 | YASNRYT | 28787 |
| vlCDR3 | QQDYSSPYT | 28788 |
| scFv | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS/GKPGSGKPGSGKPGSGKPGS/DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK | 28789 |

Figure 12A [CTLA-4]_H0.25_L0 Anti-CTLA-4 Fv sequences (XENP19235 Fab, XENP19769 scFv)

| What | sequence | SEQ ID NO: |
|---|---|---|
| Variable heavy (vh) domain | QVQLVESGGGVVQPGRSLRLSCAASGFTFSSYAMHWVRQAPGNGLEWVTFISYDGNNKYYADSVKGRFTISRDNSKNTLYLQMNSLRAEDTAIYYCARTGWLGPFDYWGQGTLVTVSS | 28790 |
| vhCDR1 | SYAMH | 28791 |
| vhCDR2 | FISYDGNNKYYADSVKG | 28792 |
| vhCDR3 | TGWLGPFDY | 28793 |
| scFv linker | GKPGSGKEGSGKPGSGKPGS | 28794 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28795 |
| vlCDR1 | RASQSVGSSYLA | 28796 |
| vlCDR2 | GAFSRAT | 28797 |
| vlCDR3 | QQYGSSPWT | 28798 |
| scFv | QVQLVESGGGVVQPGRSLRLSCAASGFTFSSYAMHWVRQAPGNGLEWVTFISYDGNNKYYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK/ | 28799 |

Figure 12B [CTLA-4]_H0.26_L0 Anti-CTLA-4 Fv sequences (XENP19236 Fab, XENP19770 scFv)

| What | sequence | SEQ ID NO: |
|---|---|---|
| Variable heavy (vh) domain | QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS | 28800 |
| vhCDR1 | SYGMH | 28801 |
| vhCDR2 | FISYDGNNKYYADSVKG | 28802 |
| vhCDR3 | TGWLGPFDY | 28803 |
| scFv linker | GKPGSGKPGSGKPGSGKPGS | 28804 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28805 |
| vlCDR1 | RASQSVGSSYLA | 28806 |
| vlCDR2 | GAFSRAT | 28807 |
| vlCDR3 | QQYGSSPWT | 28808 |
| scFv | QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28809 |

Figure 12C [CTLA-4]_H0.27_L0 Anti-CTLA-4 Fv sequences (XENP19237 Fab, XENP19771 scFv)

| What | sequence | SEQ ID NO: |
|---|---|---|
| Variable heavy (vh) domain | QVQLVESGGGVVQPGRSLRLSCAASGFTFSSYSMRWVRQAPGKGLEWVTFISYDGNNKYYADSVKGRFTISRDNSKNTLYLQMNSLRAEDTAIYYCARTGWLGPFDYWGQGTLVTVSS | 28810 |
| vhCDR1 | SYSMR | 28811 |
| vhCDR2 | FISYDGNNKYYADSVKG | 28812 |
| vhCDR3 | TGWLGPFDY | 28813 |
| scFv linker | GKPGSGKPGSGKPGS | 28814 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28815 |
| vlCDR1 | RASQSVGSSYLA | 28816 |
| vlCDR2 | GAFSRAT | 28817 |
| vlCDR3 | QQYGSSPWT | 28818 |
| scFv | QVQLVESGGGVVQPGRSLRLSCAASGFTFSSYSMRWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28819 |

Figure 12D [CTLA-4]_H0.29_L0 Fab XENP19773, scFv XENP19239

| What | sequence | SEQ ID NO: |
|---|---|---|
| Variable heavy (vh) domain | | |
| vhCDR1 | | |
| vhCDR2 | | |
| vhCDR3 | | |
| scFv linker | GKPGSGKPGSGKPGS | 28820 |
| Variable light (vl) domain | | |
| vlCDR1 | | |
| vlCDR2 | | |
| vlCDR3 | | |
| scFv | QVQLVESGGGVVQPGRSLRLSCAASGFTFSSYSMRWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28821 |

Figure 12E [CTLA-4]_H0.38_L0 (Fab XENP19248, scFv XENP19782)

| What | sequence | SEQ ID NO: |
|---|---|---|
| Variable heavy (vh) domain | QVQLVESGGGVVQPGRSLRLSCAASGFTFSSYTMHWVRQAPGKGLEWVAFISYDGNNKYYADSVKGRFTISRDNSKNTL YLQMNSLRAEDTAIYYCARTGWLGPFDYWGQGTLVTVSS | 28822 |
| vhCDR1 | SYTMH | 28823 |
| vhCDR2 | FISYDGNNKYYADSVKG | 28824 |
| vhCDR3 | TGWLGPFDY | 28825 |
| scFv linker | GKPGSGKPGSGKPGSGKPGS | 28826 |
| Variable light (vl) domain | EIVLTQSPGTLSLSPGERATLSCRASQSVGSSYLAWYQQKPGQAPRLLIYGAFSRAHGIPDRFSGSGSGTDFTLTISRL EPEDFAVYYCQQYGSSPWTFGQGTKVEIK | 28827 |
| vlCDR1 | RASQSVGSSYLA | 28828 |
| vlCDR2 | GAFSRAT | 28829 |
| vlCDR3 | QQYGSSPWT | 28830 |
| scFv | QVQLVESGGGVVQPGRSLRLSCAASGFTFSSYTMHWVRQAPGKGLEWVAFISYDGNNKYYADSVKGRFTISRDNSKNTL YLQMNSLRAEDTAIYYCARTGWLGPFDYWGQGTLVTVSS/GKPGSGKPGSGKPGSGKPGS/EIVLTQSPGTLSLSPGER ATLSCRASQSVGSSYLAWYQQKPGQAPRLLIYGAFSRAHGIPDRFSGSGSGTDFTLTISRLEPEDFAVYYCQQYGSSPW TFGQGTKVEIK/ | 28831 |

Figure 12F [CTLA-4]_H0.39_L0 (Fab XENP19249, scFv XENP19783)

| What | sequence | SEQ ID NO: |
|---|---|---|
| Variable heavy (vh) domain | QVQLVESGGGVVQPGRSLRLSCAASGFTFSSYTMHWVRQAPGKGLEWVGFISYDGNNKYYADSVKGRFTISRDNSKNTL YLQMNSLRAEDTAIYYCARTGWLGPFDYWGQGTLVTVSS | 28832 |
| vhCDR1 | SYTMH | 28833 |
| vhCDR2 | FISYDGNNKYYADSVKG | 28834 |
| vhCDR3 | TGWLGPFDY | 28835 |
| scFv linker | GKPGSGKPGSGKPGSGKPGS | 28836 |
| Variable light (vl) domain | EIVLTQSPGTLSLSPGERATLSCRASQSVGSSYLAWYQQKPGQAPRLLIYGAFSRATGIPDRFSGSGSGTDFTLTISRL EPEDFAVYYCQQYGSSFWTFGQGTKVEIK | 28837 |
| vlCDR1 | RASQSVGSSYLA | 28838 |
| vlCDR2 | GAFSRAT | 28839 |
| vlCDR3 | QQYGSSFWT | 28840 |
| scFv | QVQLVESGGGVVQPGRSLRLSCAASGFTFSSYTMHWVRQAPGKGLEWVGFISYDGNNKYYADSVKGRFTISRDNSKNTL YLQMNSLRAEDTAIYYCARTGWLGPFDYWGQGTLVTVSS/GKPGSGKPGSGKPGSGKPGS/EIVLTQSPGTLSLSPGER ATLSCRASQSVGSSYLAWYQQKPGQAPRLLIYGAFSRATGIPDRFSGSGSGTDFTLTISRLEPEDFAVYYCQQYGSSPW TFGQGTKVEIK | 28841 |

Figure 12G [CTLA-4]_H0.4Q_L0 (Fab XENP19250, scFv XENP19784)

| What | sequence | SEQ ID NO: |
|---|---|---|
| Variable heavy (vh) domain | QVQLVESGGGVVQPGRSLRLSCAASGFTFSSYTMHWVRQAPGKGLEWVSFISYDGNNKYADSVKGRFTISRDNSKNTLYLQMNSLRAEDTAIYYCARTGWLGPFDYWGQGTLVTVSS | 28842 |
| vhCDR1 | SYTMH | 28843 |
| vhCDR2 | FISYDGNNKYADSVKG | 28844 |
| vhCDR3 | TGWLGPFDY | 28845 |
| scFv linker | GKPGSGKPGSGKPGSGKPGS | 28846 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28847 |
| vlCDR1 | RASQSVGSSYLA | 28848 |
| vlCDR2 | GAFSRAT | 28849 |
| vlCDR3 | QQYGSSPWT | 28850 |
| scFv | QVQLVESGGGVVQPGRSLRLSCAASGFTFSSYTMHWVRQAPGKGLEWVSFISYDGNNKYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28851 |

Figure 12H [CTLA-4]_H0.7Q_L0 (Fab XENP19280, scFv XENP19818)

| What | sequence | SEQ ID NO: |
|---|---|---|
| Variable heavy (vh) domain | QVQLVESGGGVVQPGRSLRLSCAASGFTFSSYTMHWVRQAPGKGLEWVTFISYDGSNKYADSVKGRFTISRDNSKNTLYLQMNSLRAEDTAIYYCARTGWLGPFDYWGQGTLVTVSS | 28852 |
| vhCDR1 | SYTMH | 28853 |
| vhCDR2 | FISYDGSNKYADSVKG | 28854 |
| vhCDR3 | TGWLGPFDY | 28855 |
| scFv linker | GKPGSGKPGSGKPGSGKPGS | 28856 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28857 |
| vlCDR1 | RASQSVGSSYLA | 28858 |
| vlCDR2 | GAFSRAT | 28859 |
| vlCDR3 | QQYGSSPWT | 28860 |
| scFv | QVQLVESGGGVVQPGRSLRLSCAASGFTFSSYTMHWVRQAPGKGLEWVTFISYDGSNKYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28861 |

Figure 12I [CTLA-4]_H0_L0.22 (Fab XENP19437, scFv XENP19910)

| What | sequence | SEQ ID NO: |
|---|---|---|
| Variable heavy (vh) domain | QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS | 28862 |
| vhCDR1 | SYTMH | 28863 |
| vhCDR2 | FISYDGNNKYYADSVKG | 28864 |
| vhCDR3 | TGWLGPFDY | 28865 |
| scFv linker | GKPGSGKPGSGKPGSGKPGS | 28866 |
| Variable light (vl) domain | EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 28867 |
| vlCDR1 | RASQSVSSYLA | 28868 |
| vlCDR2 | GAFSRAT | 28869 |
| vlCDR3 | QQYGSSPWT | 28870 |
| scFv | QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 28871 |

Figure 12J [CTLA-4]_H2_L0 (Fab XENP19545 scFv XENP19552)

| What | sequence | SEQ ID NO: |
|---|---|---|
| Variable heavy (vh) domain | EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSS | 28872 |
| vhCDR1 | SYTMH | 28873 |
| vhCDR2 | FISYDGNNKYYPGSVKG | 28874 |
| vhCDR3 | TGWLGPFDY | 28875 |
| scFv linker | GKPGSGKPGSGKPGSGKPGS | 28876 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28877 |
| vlCDR1 | RASQSVGSSYLA | 28878 |
| vlCDR2 | GAFSRAT | 28879 |
| vlCDR3 | QQYGSSPWT | 28880 |
| scFv | EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28881 |

Figure 12K [CTLA-4]_H3.21_L0.124 (Fab XENP20422, scFv XENP20431)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS | 28882 |
| vhCDR1 | SYTMH | 28883 |
| vhCDR2 | FISYDGNTKYYADSVKG | 28884 |
| vhCDR3 | GGLLGFFDL | 28885 |
| scFv linker | GKPGSGKPGSGKPGSGKPGS | 28886 |
| Variable light (vl) domain | EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28887 |
| vlCDR1 | RASQSVGSSYLA | 28888 |
| vlCDR2 | GASSRAT | 28889 |
| vlCDR3 | QQYGSSPWT | 28890 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS/GKPGSGKPGSGKPGSGKPGS/EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28891 |

Figure 12L [CTLA-4]_H3.21_L0.129 (Fab XENP20423, scFv XENP20432)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS | 28892 |
| vhCDR1 | SYTMH | 28893 |
| vhCDR2 | FISYDGNTKYYADSVKG | 28894 |
| vhCDR3 | GGLLGFFDL | 28895 |
| scFv linker | GKPGSGKPGSGKPGSGKPGS | 28896 |
| Variable light (vl) domain | EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28897 |
| vlCDR1 | RASQSVGSSYLA | 28898 |
| vlCDR2 | GASSRAT | 28899 |
| vlCDR3 | QQYGSSPWT | 28900 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28901 |

Figure 12M [CTLA-4]_H3.21_L0.132 (Fab XENP20424, scFv XENP20433)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS | 28902 |
| vhCDR1 | SYTMH | 28903 |
| vhCDR2 | FISYDGNTKYYADSVKG | 28904 |
| vhCDR3 | GGLLGFFDL | 28905 |
| scFv linker | GKPGSGKPGSGKPGSGKPGS | 28906 |
| Variable light (vl) domain | EIVLTQSPATLSLSPGERATLSCRASQSVGSSYLAWYQQKPGQAPRLLIYGASSPATGIPDRFSGSGSGTDFTLTISRLEPEDFAVYYCQQYGSSPWTFGQGTKVEIK | 28907 |
| vlCDR1 | RASQSVGSSYLA | 28908 |
| vlCDR2 | GASSRAT | 28909 |
| vlCDR3 | QQYGSSPWT | 28910 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGFFDLWGQGTMVTVSS/GKPGSGKPGSGKPGSGKPGS/EIVLTQSPATLSLSPGERATLSCRASQSVGSSYLAWYQQKPGQAPRLLIYGASSPATGIPDRFSGSGSGTDFTLTISRLEPEDFAVYYCQQYGSSPWTFGQGTKVEIK | 28911 |

Figure 12N [CTLA-4]_H3.23_L0.124 (Fab XENP20425, scFv XENP20434)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS | 28912 |
| vhCDR1 | SYTMH | 28913 |
| vhCDR2 | FISYDGNYKYYADSVKG | 28914 |
| vhCDR3 | GGLLGFFDL | 28915 |
| scFv linker | GKPGSGKPGSGKPGSGKPGS | 28916 |
| Variable light (vl) domain | EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28917 |
| vlCDR1 | RASQSVGSSYLA | 28918 |
| vlCDR2 | GASSRAT | 28919 |
| vlCDR3 | QQYGSSPWT | 28920 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS/GKPGSGKPGSGKPGSGKPGS/EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28921 |

Figure 12O [CTLA-4]_H3.23_L0.129 (Fab XENP20426, scFv XENP20435)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS | 28922 |
| vhCDR1 | SYTMH | 28923 |
| vhCDR2 | FISYDGNYKYYADSVKG | 28924 |
| vhCDR3 | GGHLGPFDL | 28925 |
| scFv linker | GKPGSGKPGSGKPGSGKPGS | 28926 |
| Variable light (vl) domain | EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28927 |
| vlCDR1 | RASQSVGSSYLA | 28928 |
| vlCDR2 | GASSRAT | 28929 |
| vlCDR3 | QQYGSSPWT | 28930 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28931 |

Figure 12P [CTLA-4]_H3.23_L0.132 (Fab XENP20427, scFv XENP20436)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS | 28932 |
| vhCDR1 | SYTMH | 28933 |
| vhCDR2 | FISYDGNYKYYADSVKG | 28934 |
| vhCDR3 | GGHLGPFDL | 28935 |
| scFv linker | GKPGSGKPGSGKPGSGKPGS | 28936 |
| Variable light (vl) domain | EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 28937 |
| vlCDR1 | RASQSVSSSYLA | 28938 |
| vlCDR2 | GASSRAT | 28939 |
| vlCDR3 | QQYGSSPWT | 28940 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGSGKPGSGKPGS/EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 28941 |

Figure 12Q [CTLA-4]_H3.25_L0.124 (Fab XENP20428, scFv XENP20437)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGLLGFFDLWGQGTMVTVSS | 28942 |
| vhCDR1 | SYTMH | 28943 |
| vhCDR2 | FISYDGNYKYYADSVKG | 28944 |
| vhCDR3 | GGLLGFFDL | 28945 |
| scFv linker | GKPGSGKPGSGKPGSGKPGS | 28946 |
| Variable light (vl) domain | EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28947 |
| vlCDR1 | RASQSVGSSYLA | 28948 |
| vlCDR2 | GASSRAT | 28949 |
| vlCDR3 | QQYGSSPWT | 28950 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGLLGFFDLWGQGTMVTVSS/GKPGSGKPGSGKPGSGKPGS/EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28951 |

Figure 12R [CTLA-4]_H3.25_L0.129 (Fab XENP20429, scFv XENP20438)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGLLGFFDLWGQGTMVTVSS | 28952 |
| vhCDR1 | SYTMH | 28953 |
| vhCDR2 | FISYDGNYKYYADSVKG | 28954 |
| vhCDR3 | GGLLGFFDL | 28955 |
| scFv linker | GKPGSGKPGSGKPGSGKPGS | 28956 |
| Variable light (vl) domain | EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28957 |
| vlCDR1 | RASQSVGSSYLA | 28958 |
| vlCDR2 | GASSRAT | 28959 |
| vlCDR3 | QQYGSSPWT | 28960 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGLLGFFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 28961 |

Figure 12S [CTLA-4]_H3.25_L0.132 (Fab XENP20430, scFv XENP20439)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS | 28962 |
| vhCDR1 | SYTMH | 28963 |
| vhCDR2 | FISYDGNYKYYADSVKG | 28964 |
| vhCDR3 | GGLLGFFDL | 28965 |
| scFv linker | GKPGSGKPGSGKPGS | 28966 |
| Variable light (vl) domain | EIVLTQSPATLSLSPGERATLSCRASQSVSSSYLAWYQQKPGQAPRLLIYGASSRAHGIPDRFSGSGSGTDFTLTISRLEPEDFAVYYCQQYGSSPWTFGQGTKVEIK | 28967 |
| vlCDR1 | RASQSVSSSYLA | 28968 |
| vlCDR2 | GASSRAH | 28969 |
| vlCDR3 | QQYGSSPWT | 28970 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS/GKPGSGKPGSGKPGS/EIVLTQSPATLSLSPGERATLSCRASQSVSSSYLAWYQQKPGQAPRLLIYGASSRAHGIPDRFSGSGSGTDFTLTISRLEPEDFAVYYCQQYGSSPWTFGQGTKVEIK | 28971 |

Figure 12T [CTLA-4]_H3.4_L0.118 (Fab XENP20341, scFv XENP20378)

| What | sequence | SEQ ID NO: |
|---|---|---|
| Variable heavy (vh) domain | EVQLVESGGGLVKPGGSLRLSCAASGFTFSSYIMHWVRQAPGKGLEWVSFISYDGNEKYYADSVKGRFTISRDNAKNSLYLQMNSLRAEDTAVYYCARTGHLGFFDLWGQGTMVTVSS | 28972 |
| vhCDR1 | SSYIMH | 28973 |
| vhCDR2 | FISYDGNEKYYADSVKG | 28974 |
| vhCDR3 | TGHLGFFDL | 28975 |
| scFv linker | GKPGSGKPGSGKPGS | 28976 |
| Variable light (vl) domain | EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28977 |
| vlCDR1 | RASQSVGSSYLA | 28978 |
| vlCDR2 | GAFSRAT | 28979 |
| vlCDR3 | QQYGSSPWT | 28980 |
| scFv | EVQLVESGGGLVKPGGSLRLSCAASGFTFSSYIMHWVRQAPGKGLEWVSFISYDGNEKYYADSVKGRFTISRDNAKNSLYLQMNSLRAEDTAVYYCARTGHLGFFDLWGQGTMVTVSS/GKPGSGKPGSGKPGS/EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28981 |

Figure 12U [CTLA-4]_H3.4_L0.119 (Fab XENP20342, scFv XENP20379)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGFFDLWGQGTMVTVSS | 28982 |
| vhCDR1 | SYTMH | 28983 |
| vhCDR2 | FISYDGNHKYYADSVKG | 28984 |
| vhCDR3 | TGHLGFFDL | 28985 |
| scFv linker | GKPGSGKPGSGKPGSGKPGS | 28986 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28987 |
| vlCDR1 | RASQSVGSSYLA | 28988 |
| vlCDR2 | GAFSRAT | 28989 |
| vlCDR3 | QQYGSSPWT | 28990 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGFFDLWGQGTMVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28991 |

Figure 12V [CTLA-4]_H3.4_L0.12 (Fab XENP20071, scFv XENP20078)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGFFDLWGQGTMVTVSS | 28992 |
| vhCDR1 | SYTMH | 28993 |
| vhCDR2 | FISYDGNHKYYADSVKG | 28994 |
| vhCDR3 | TGHLGFFDL | 28995 |
| scFv linker | GKPGSGKPGSGKPGSGKPGS | 28996 |
| Variable light (vl) domain | EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 28997 |
| vlCDR1 | RASQSVGSSYLA | 28998 |
| vlCDR2 | GAFSRAT | 28999 |
| vlCDR3 | QQYGSSPWT | 29000 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGFFDLWGQGTMVTVSS/GKPGSGKPGSGKPGSGKPGS/EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 29001 |

Figure 12W [CTLA-4]_H3.4_L0.121 (Fab XENP20344, scFv XENP20381)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29002 |
| vhCDR1 | SYTMH | 29003 |
| vhCDR2 | FISYDGNHKYYADSVKG | 29004 |
| vhCDR3 | TGHLGPFDL | 29005 |
| scFv linker | GKPGSGKPGSGKPGSGKPGS | 29006 |
| Variable light (vl) domain | EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 29007 |
| vlCDR1 | RASQSVGSSYLA | 29008 |
| vlCDR2 | GASSRAT | 29009 |
| vlCDR3 | QQYGSSPWT | 29010 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 29011 |

Figure 12X [CTLA-4]_H3.4_L0.122 (Fab XENP20345, scFv XENP20382)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29012 |
| vhCDR1 | SYTMH | 29013 |
| vhCDR2 | FISYDGNHKYYADSVKG | 29014 |
| vhCDR3 | TGHLGPFDL | 29015 |
| scFv linker | GKPGSGKPGSGKPGSGKPGS | 29016 |
| Variable light (vl) domain | EIVLTQSPATLSLSPGERATLSCRASQSVGSSYLAWYQQKPGQAPRLLIYGAFSRAHGIPDRFSGSGSGTDFTLTISRLEPEDFAVYYCQQYGSSPWTFGQGTKVEIK | 29017 |
| vlCDR1 | RASQSVGSSYLA | 29018 |
| vlCDR2 | GAFSRAH | 29019 |
| vlCDR3 | QQYGSSPWT | 29020 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSLSPGERATLSCRASQSVGSSYLAWYQQKPGQAPRLLIYGAFSRAHGIPDRFSGSGSGTDFTLTISRLEPEDFAVYYCQQYGSSPWTFGQGTKVEIK | 29021 |

Figure 12Y [CTLA-4]_H3.4_L0.123 (Fab XENP20346, scFv XENP20383)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29022 |
| vhCDR1 | SYTMH | 29023 |
| vhCDR2 | FISYDGNHKYYADSVKG | 29024 |
| vhCDR3 | TGHLGPFDL | 29025 |
| scFv linker | GKPGSGKPGSGKPGSGKPGS | 29026 |
| Variable light (vl) domain | EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 29027 |
| vlCDR1 | RASQSVGSSYLA | 29028 |
| vlCDR2 | GAFSRAT | 29029 |
| vlCDR3 | QQYGSSPWT | 29030 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 29031 |

Figure 12Z [CTLA-4]_H3.4_L0.124 (Fab XENP20347, scFv XENP20384)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29032 |
| vhCDR1 | SYTMH | 29033 |
| vhCDR2 | FISYDGNHKYYADSVKG | 29034 |
| vhCDR3 | TGHLGPFDL | 29035 |
| scFv linker | GKPGSGKPGSGKPGSGKPGS | 29036 |
| Variable light (vl) domain | EIVLTQSPATLSVSPGERATLSCRASQSVGSSYLAWYQQKPGQAPRLLIYGASSRAHGIPDRFSGSGSGTDFTLTISRLEPEDFAVYYCQQYGSSPWTFGQGTKVEIK | 29037 |
| vlCDR1 | RASQSVGSSYLA | 29038 |
| vlCDR2 | GASSRAH | 29039 |
| vlCDR3 | QQYGSSPWT | 29040 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSVSPGERATLSCRASQSVGSSYLAWYQQKPGQAPRLLIYGASSRAHGIPDRFSGSGSGTDFTLTISRLEPEDFAVYYCQQYGSSPWTFGQGTKVEIK | 29041 |

Figure 12AA [CTLA-4]_H3.4_L0.125 (Fab XENP20348, scFv XENP20385)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS | 29042 |
| vhCDR1 | SYTMH | 29043 |
| vhCDR2 | FISYDGNHKYYADSVKG | 29044 |
| vhCDR3 | TGHLGPFDL | 29045 |
| scFv linker | GKPGSGKPGSGKPGSGKPGS | 29046 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDF AVYYCQQYGSSPWTFGQGTKVEIK | 29047 |
| vlCDR1 | RASQSVGSSYLA | 29048 |
| vlCDR2 | GAFSRAT | 29049 |
| vlCDR3 | QQYGSSPWT | 29050 |
| scFv | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS/GKPGSGKPGSGKPGSGKPGS/EIVLTQSPGTLSLSPGERATLSCRASQS VGSSYLAWYQQKPGQAPRLLIYGAFSRATGIPDRFSGSGSGTDFTLTISRLEPEDFAVYYCQQYGSSPWTFGQGTKVEIK | 29051 |

Figure 12BB [CTLA-4]_H3.4_L0.126 (Fab XENP20349, scFv XENP20386)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS | 29052 |
| vhCDR1 | SYTMH | 29053 |
| vhCDR2 | FISYDGNHKYYADSVKG | 29054 |
| vhCDR3 | TGHLGPFDL | 29055 |
| scFv linker | GKPGSGKPGSGKPGSGKPGS | 29056 |
| Variable light (vl) domain | EIVLTQSPGTLSLSPGERATLSCRASQSVGSSYLAWYQQKPGQAPRLLIYGASSRAHGIPDRFSGSGSGTDFTLTISRLEPEDF AVYYCQQYGSSPWTFGQGTKVEIK | 29057 |
| vlCDR1 | RASQSVGSSYLA | 29058 |
| vlCDR2 | GASSRAH | 29059 |
| vlCDR3 | QQYGSSPWT | 29060 |
| scFv | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS/GKPGSGKPGSGKPGSGKPGS/EIVLTQSPGTLSLSPGERATLSCRASQS VGSSYLAWYQQKPGQAPRLLIYGASSRAHGIPDRFSGSGSGTDFTLTISRLEPEDFAVYYCQQYGSSPWTFGQGTKVEIK | 29061 |

Figure 12CC [CTLA-4]_H3.4_L0.127 (Fab XENP20350, scFv XENP20387)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29062 |
| vhCDR1 | SYTMH | 29063 |
| vhCDR2 | FISYDGNHKYYADSVKG | 29064 |
| vhCDR3 | TGHLGPFDL | 29065 |
| scFv linker | GKPGSGKPGSGKPGSGKPGS | 29066 |
| Variable light (vl) domain | EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 29067 |
| vlCDR1 | RASQSVSSSYLA | 29068 |
| vlCDR2 | GASSRAT | 29069 |
| vlCDR3 | QQYGSSPWT | 29070 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 29071 |

Figure 12DD [CTLA-4]_H3.4_L0.128 (Fab XENP20351, scFv XENP20388)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 29072 |
| vhCDR1 | SYTMH | 29073 |
| vhCDR2 | FISYDGNHKYYADSVKG | 29074 |
| vhCDR3 | TGHLGPFDL | 29075 |
| scFv linker | GKPGSGKPGSGKPGSGKPGS | 29076 |
| Variable light (vl) domain | EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 29077 |
| vlCDR1 | RASQSVSSSYLA | 29078 |
| vlCDR2 | GAFSRAT | 29079 |
| vlCDR3 | QQYGSSPWT | 29080 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 29081 |

Figure 12EE [CTLA-4]_H3.4_L0.129 (Fab XENP20352, scFv XENP20389)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | |
| vhCDR1 | SYTMH | |
| vhCDR2 | FISYDGNHKYYADSVKG | |
| vhCDR3 | TGHLGPFDL | |
| scFv linker | GKPGSGKPGSGKPGS | 29082 |
| Variable light (vl) domain | EIVLTQSPATLSLSPGERATLSCRASQSVGSSYLAWYQQKPGQAPRLLIYGASSRATGIPDRFSGSGSGTDFTLTISRLEPED FAVYYCQQYGSSPWTFGQGTKVEIK | 29083 |
| vlCDR1 | RASQSVGSSYLA | 29084 |
| vlCDR2 | GASSRAT | 29085 |
| vlCDR3 | QQYGSSPWT | 29086 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGS/EIVLTQSPATLSLSPGERATLSCRAS QSVGSSYLAWYQQKPGQAPRLLIYGASSRATGIPDRFSGSGSGTDFTLTISRLEPEDFAVYYCQQYGSSPWTFGQGTKVEIK | 29087 |

Figure 12FF [CTLA-4]_H3.4_L0.130 (Fab XENP20353, scFv XENP20390)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | 29088 |
| vhCDR1 | SYTMH | 29089 |
| vhCDR2 | FISYDGNHKYYADSVKG | 29090 |
| vhCDR3 | TGHLGPFDL | 29091 |
| scFv linker | GKPGSGKPGSGKPGS | 29092 |
| Variable light (vl) domain | EIVLTQSPATLSVSPGERATLSCRASQSVSSSYLAWYQQKPGQAPRLLIYGASSRATGIPDRFSGSGSGTDFTLTISRLEPED FAVYYCQQYGSSPWTFGQGTKVEIK | 29093 |
| vlCDR1 | RASQSVSSSYLA | 29094 |
| vlCDR2 | GASSRAT | 29095 |
| vlCDR3 | QQYGSSPWT | 29096 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGS/EIVLTQSPATLSVSPGERATLSCRAS QSVSSSYLAWYQQKPGQAPRLLIYGASSRATGIPDRFSGSGSGTDFTLTISRLEPEDFAVYYCQQYGSSPWTFGQGTKVEIK | 29097 |

Figure 12GG [CTLA-4]_H3.4_L0.131 (Fab XENP20354, scFv XENP20391)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | 29098 |
| vhCDR1 | SYTMH | 29099 |
| vhCDR2 | FISYDGNHKYYADSVKG | 29100 |
| vhCDR3 | TGHLGPFDL | 29101 |
| scFv linker | GKPGSGKPGSGKPGSGKPGS | 29102 |
| Variable light (vl) domain | EIVLTQSPGTLSLSPGERATLSCRASQSVSSSYLAWYQQKPGQAPRLLIYGASSRATGIPDRFSGSGSGTDFTLTISRLEPED FAVYYCQQYGSSPWTFGQGTKVEIK | 29103 |
| vlCDR1 | RASQSVSSSYLA | 29104 |
| vlCDR2 | GASSRAT | 29105 |
| vlCDR3 | QQYGSSPWT | 29106 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGSGKPGS/EIVLTQSPGTLSLSPGERATLSCRAS QSVSSSYLAWYQQKPGQAPRLLIYGASSRATGIPDRFSGSGSGTDFTLTISRLEPEDFAVYYCQQYGSSPWTFGQGTKVEIK | 29107 |

Figure 12HH [CTLA-4]_H3.4_L0.132 (Fab XENP20355, scFv XENP20392)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | 29108 |
| vhCDR1 | SYTMH | 29109 |
| vhCDR2 | FISYDGNHKYYADSVKG | 29110 |
| vhCDR3 | TGHLGPFDL | 29111 |
| scFv linker | GKPGSGKPGSGKPGSGKPGS | 29112 |
| Variable light (vl) domain | EIVLTQSPATLSLSPGERATLSCRASQSVSSSYLAWYQQKPGQAPRLLIYGASSRAHGIPDRFSGSGSGTDFTLTISRLEPED FAVYYCQQYGSSPWTFGQGTKVEIK | 29113 |
| vlCDR1 | RASQSVSSSYLA | 29114 |
| vlCDR2 | GASSRAH | 29115 |
| vlCDR3 | QQYGSSPWT | 29116 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGSGKPGS/EIVLTQSPATLSLSPGERATLSCRAS QSVSSSYLAWYQQKPGQAPRLLIYGASSRAHGIPDRFSGSGSGTDFTLTISRLEPEDFAVYYCQQYGSSPWTFGQGTKVEIK | 29117 |

Figure 12II [CTLA-4]_H3.5_L2.1 (Fab XENP20357, scFv XENP20394)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS | 29118 |
| vhCDR1 | SYTMH | 29119 |
| vhCDR2 | FISYDGNTKYYADSVKG | 29120 |
| vhCDR3 | TGHLGPFDL | 29121 |
| scFv linker | GKPGSGKPGSGKPGSGKPGS | 29122 |
| Variable light (vl) domain | EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK | 29123 |
| vlCDR1 | RASQSVGSSYLA | 29124 |
| vlCDR2 | GAFSRAT | 29125 |
| vlCDR3 | QQYGSSPWT | 29126 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK | 29127 |

Figure 12JJ [CTLA-4]_H3.5_L2.2 (Fab XENP20358, scFv XENP20395)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS | 29128 |
| vhCDR1 | SYTMH | 29129 |
| vhCDR2 | FISYDGNTKYYADSVKG | 29130 |
| vhCDR3 | TGHLGPFDL | 29131 |
| scFv linker | GKPGSGKPGSGKPGSGKPGS | 29132 |
| Variable light (vl) domain | EIVMTQSPATLSVSPGERATLSCRASQSVGSSYLAWYQQKPGQAPRLLIYGASSRAKGIPARFSGSGSGTEFTLTISSLQSEDFAVYYCQQYGSSPWTFGQGTKVEIK | 29133 |
| vlCDR1 | RASQSVGSSYLA | 29134 |
| vlCDR2 | GASSRAT | 29135 |
| vlCDR3 | QQYGSSPWT | 29136 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVGSSYLAWYQQKPGQAPRLLIYGASSRAKGIPARFSGSGSGTEFTLTISSLQSEDFAVYYCQQYGSSPWTFGQGTKVEIK | 29137 |

Figure 12KK [CTLA-4]_H3.5_L2.3 (Fab XENP20359, scFv XENP20396)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS | 29138 |
| vhCDR1 | SYTMH | 29139 |
| vhCDR2 | FISYDGNTKYYADSVKG | 29140 |
| vhCDR3 | TGHLGPFDL | 29141 |
| scFv linker | GKPGSGKPGSGKPGSGKPGS | 29142 |
| Variable light (vl) domain | EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK | 29143 |
| vlCDR1 | RASQSVGSSYLA | 29144 |
| vlCDR2 | GASSRAT | 29145 |
| vlCDR3 | QQYGSSPWT | 29146 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK | 29147 |

Figure 12LL [CTLA-4]_H3_L0 (Fab XENP19546, scFv XENP19553)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGMLGPFDYWGQGTLVTVSS | 29148 |
| vhCDR1 | SYTMH | 29149 |
| vhCDR2 | FISYDGNNKYYADSVKG | 29150 |
| vhCDR3 | TGMLGPFDY | 29151 |
| scFv linker | GKPGSGKPGSGKPGSGKPGS | 29152 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 29153 |
| vlCDR1 | RASQSVGSSYLA | 29154 |
| vlCDR2 | GAFSRAT | 29155 |
| vlCDR3 | QQYGSSPWT | 29156 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGMLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 29157 |

Figure 12MM [CTLA-4]_H3_L0.22 (Fab XENP20011)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 29158 |
| vhCDR1 | SYTMH | 29159 |
| vhCDR2 | FISYDGNNKYYADSVKG | 29160 |
| vhCDR3 | TGWLGPFDY | 29161 |
| scFv linker | GKPGSGKPGSGKPGS | 29162 |
| Variable light (vl) domain | EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 29163 |
| vlCDR1 | RASQSVSSSYLA | 29164 |
| vlCDR2 | GAFSRAT | 29165 |
| vlCDR3 | QQYGSSPWT | 29166 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGS/EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 29167 |

Figure 12NN [CTLA-4]_H3_L0.44 (Fab XENP20052)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 29168 |
| vhCDR1 | SYTMH | 29169 |
| vhCDR2 | FISYDGNNKYYADSVKG | 29170 |
| vhCDR3 | TGWLGPFDY | 29171 |
| scFv linker | GKPGSGKPGSGKPGS | 29172 |
| Variable light (vl) domain | EIVLTQSPGTLSLSPGERATLSCRASQSVSSSYLSWYQQKPGQAPRLLIYGAFSRATGIPDRFSGSGSGTDFTLTISRLEPEDFAV YYCQQYGSSPWTFGQGTKVEIK | 29173 |
| vlCDR1 | RASQSVSSSYLS | 29174 |
| vlCDR2 | GAFSRAT | 29175 |
| vlCDR3 | QQYGSSPWT | 29176 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGS/EIVLTQSPGTLSLSPGERATLSCRASQSVSSSYLSWYQQKPGQAPRLLIYGAFSRATGIPDRFSGSGSGTDFTLTISRLEPEDFAVYYCQQYGSSPWTFGQGTKVEIK | 29177 |

Figure 12OO [CTLA-4] H3_L0.67 (Fab XENP20018)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 29178 |
| vhCDR1 | SYTMH | 29179 |
| vhCDR2 | FISYDGNNKYYADSVKG | 29180 |
| vhCDR3 | TGWLGPFDY | 29181 |
| scFv linker | GKPGSGKPGSGKPGSGKPGS | 29182 |
| Variable light (vl) domain | EIVLTQSPGTLSLSPGERATLSCKASQSVGSSYLAWYQQKPGQAPRLLIYDAFSRATGIPDRFSGSGSGTDFTLTISRLEPEDFAVYYCQQYGSSPWTFGQGTKVEIK | 29183 |
| vlCDR1 | RASQSVGSSYLA | 29184 |
| vlCDR2 | DAFSRAT | 29185 |
| vlCDR3 | QQYGSSPWT | 29186 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGSGKPGS/EIVLTQSPGTLSLSPGERATLSCKASQSVGSSYLAWYQQKPGQAPRLLIYDAFSRATGIPDRFSGSGSGTDFTLTISRLEPEDFAVYYCQQYGSSPWTFGQGTKVEIK | 29187 |

Figure 12PP [CTLA-4] H3_L0.74 (Fab XENP20020)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 29188 |
| vhCDR1 | SYTMH | 29189 |
| vhCDR2 | FISYDGNNKYYADSVKG | 29190 |
| vhCDR3 | TGWLGPFDY | 29191 |
| scFv linker | GKPGSGKPGSGKPGSGKPGS | 29192 |
| Variable light (vl) domain | EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK | 29193 |
| vlCDR1 | RASQSVGSSYLA | 29194 |
| vlCDR2 | GAYSRAT | 29195 |
| vlCDR3 | QQYGSSPWT | 29196 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK | 29197 |

Figure 13A
7G8_H3.30_L1.34 (Fab XENP22594)

| What | sequence | SEQ ID NO: |
|---|---|---|
| Variable heavy (vh) domain | EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSS | 29198 |
| vhCDR1 | DAWMS | 29199 |
| vhCDR2 | EISTKANNHATYYAESVKG | 29200 |
| vhCDR3 | LATWDWYFDV | 29201 |
| Variable light (vl) domain | DIVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIK | 29202 |
| vlCDR1 | RASQSVDYDGDSYMN | 29203 |
| vlCDR2 | AASELES | 29204 |
| vlCDR3 | QQSNEDPFT | 29205 |

Figure 13B
2A11_H1.144_L2.142 (Fab XENP22656)

| What | sequence | SEQ ID NO: |
|---|---|---|
| Variable heavy (vh) domain | EVQLVQSGAEVKKPGATVKISCKASGFNIKDYEMHWVQQAPGKGLEWMGWIDPELGDTEYAPKFQGRVTITADTSTNTAYMELSSLRSEDTAVYYCYARGVYQALDYWGQGTLVTVSS | 29206 |
| vhCDR1 | DYFMH | 29207 |
| vhCDR2 | WIDPELGDTEYAPKFQG | 29208 |
| vhCDR3 | RGVYQALDY | 29209 |
| Variable light (vl) domain | DIQMTQSPAFLSVTPGEKVTITCQASQDIGNYLNWFQQKPGQTVKLLIYFTSYLHSGVPSRFSGSGSGTDYTFTISSLEAEDRAATYFCQQGNTLFYTFGGGTKVEIK | 29210 |
| vlCDR1 | QASQDIGNYLN | 29211 |
| vlCDR2 | FTSYLHS | 29212 |
| vlCDR3 | QQGNTLFYT | 29213 |

Figure 13C
7G8_H3.18_L1.11 (Fab XENP21670)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKANNHATYYAESVK GRFTISRDDSKSSVYLQMNSLRAEDTAVYYCTRLANWDYFDVWGQGTTVTVSS | 29214 |
| vhCDR1 | DAWMD | 29215 |
| vhCDR2 | EISTKANNHATYYAESVKG | 29216 |
| vhCDR3 | LANWDYFDV | 29217 |
| Variable light (vl) domain | DIVLTQSPSSLSASVGDRVTITCRASQSVDYDGDSYMNWYQQKPGKPPKLLIYAASELESGIPARLS GSGSGTDFTLTISSLQPEDFATYYCQQSNEDPFTFGSGTKLEIK | 29218 |
| vlCDR1 | RASQSVDYDGDSYMN | 29219 |
| vlCDR2 | AASELES | 29220 |
| vlCDR3 | QQSNEDPFT | 29221 |

Figure 13D
2A11_H0L0 (Fab XENP20930)

| What | sequence | SEQ ID NO: |
|---|---|---|
| Variable heavy (vh) domain | EVKLEESGGGLVQPGGSMKLSCAASGFTFSDAWMDWVRQSPEKGLEWVAEIRTKANNHATYYAESVK GRFTISRDDSKSSVYLQMNSLRAEDTGIYYCTRLANWDYFDVWGAGTTVTVSS | 29222 |
| vhCDR1 | DAWMD | 29223 |
| vhCDR2 | EIRTKANNHATYYAESVKG | 29224 |
| vhCDR3 | LANWDYFDV | 29225 |
| Variable light (vl) domain | DIVLTQSPASLAVSLGQRATISCKASQSVDYDGDSYMNWYQQKPGQPPKLLIYAASNLESGIPARLS GSGSGTDFTLNIHPVEEEDAATYYCQQSNEDPFTFGSGTKLEVK | 29226 |
| vlCDR1 | KASQSVDYDGDSYMN | 29227 |
| vlCDR2 | AASNLES | 29228 |
| vlCDR3 | QQSNEDPFT | 29229 |

Figure 13E
2A11_H1.125_L2.113 (Fab XENP21921)

| What | sequence | SEQ ID NO: |
|---|---|---|
| Variable heavy (vh) domain | EVQLVQSGAEVKKPGATVKISCKASGFNIKHYFMHWVQQAPGKGLEWMGWIDPYLGDTEYAPKFQGR VTITADTSTNTAYMELSSLRSEDTAVYYCYARGVYQALDYWGQGTLVTVSS | 29230 |
| vhCDR1 | HYFMH | 29231 |
| vhCDR2 | WIDPYLGDTEYAPKFQG | 29232 |
| vhCDR3 | RGVYQALDY | 29233 |
| Variable light (vl) domain | DIQMTQSPAFLSVTPGEKVTITCQASQDIGNYLNWFQQKPDQTVKLLIYFTSYLHSGVPSRFSGSGS GTDYTFTISSLEAEDAATYFCQQGNTLPYTFGGGTKVEIK | 29234 |
| vlCDR1 | QASQDIGNYLN | 29235 |
| vlCDR2 | FTSYLHS | 29236 |
| vlCDR3 | QQGNTLPYT | 29237 |

Figure 13F
2A11_H1L2 (Fab XENP20847)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 29238 |
| vhCDR1 | DYYMH | 29239 |
| vhCDR2 | WIDPENGDTEYAPKFQG | 29240 |
| vhCDR3 | RGVRQALDY | 29241 |
| Variable light (vl) domain | DIQMTQSPAFLSVTPGEKVTITCQASQDIGNYLNWFQQKPDQTVKLLIYYTSRLHSGVPSRFSGSGS GTDYTFTISSLEAEDAATYFCQQGNTLPYTFGGGTKVEIK | 29242 |
| vlCDR1 | QASQDIGNYLN | 29243 |
| vlCDR2 | YTSRLHS | 29244 |
| vlCDR3 | QQGNTLPYT | 29245 |

Figure 13G
2A11_H1_L2.25 (Fab XENP21372)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYAPGVRQALDYWGQGTLVTVSS | 29246 |
| vhCDR1 | DYYMH | 29247 |
| vhCDR2 | WIDPENGDTEYAPKFQG | 29248 |
| vhCDR3 | RGVRQALDY | 29249 |
| Variable light (vl) domain | DIQMTQSPAFLSVTPGEKVTITCQASQDIGNALNWFQQKPDQTVKLLIYYTSRLASGVPSRFSGSGS GTDYTFTISSLEAEDAATYFCQQGNTLPYTFGGGTKVEIK | 29250 |
| vlCDR1 | QASQDIGNALN | 29251 |
| vlCDR2 | YTSRLAS | 29252 |
| vlCDR3 | QQGNTLPYT | 29253 |

Figure 13H
2A11_H1_L2.47 (Fab XENP21394)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYAPGVRQALDYWGQGTLVTVSS | 29254 |
| vhCDR1 | DYYMH | 29255 |
| vhCDR2 | WIDPENGDTEYAPKFQG | 29256 |
| vhCDR3 | RGVRQALDY | 29257 |
| Variable light (vl) domain | DIQMTQSPAFLSVTPGEKVTITCQASQDIGNYLNWFQQKPDQTVKLLIYYTSHLASGVPSRFSGSGS GTDYTFTISSLEAEDAATYFCQQGNTLPYTFGGGTKVEIK | 29258 |
| vlCDR1 | QASQDIGNYLN | 29259 |
| vlCDR2 | YTSHLAS | 29260 |
| vlCDR3 | QQGNTLPYT | 29261 |

Figure 13I
2A11_H1_L2.50 (Fab XENP21401)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 29262 |
| vhCDR1 | DYYMH | 29263 |
| vhCDR2 | WIDPENGDTEYAPKFQG | 29264 |
| vhCDR3 | RGVRQALDY | 29265 |
| Variable light (vl) domain | DIQMTQSPAFLSVTPGEKVTITCQASQDIGNYLNWFQQKPDQTVKLLIYYTSYLHSGVPSRFSGSGS GTDYTFTISSLEAEDAATYFCQQGNTLPYTFGGGTKVEIK | 29266 |
| vlCDR1 | QASQDIGNYLN | 29267 |
| vlCDR2 | YTSYLHS | 29268 |
| vlCDR3 | QQGNTLPYT | 29269 |

Figure 13J
2A11_H1L2 (Fab XENP20847)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 29270 |
| vhCDR1 | DYYMH | 29271 |
| vhCDR2 | WIDPENGDTEYAPKFQG | 29272 |
| vhCDR3 | RGVRQALDY | 29273 |
| Variable light (vl) domain | DIQMTQSPAFLSVTPGEKVTITCQASQDIGNYLNWFQQKPDQTVKLLIYYTSRLASGVPSRFSGSGS GTDYTFTISSLEAEDAATYFCQQGNTLPYTFGGGTKVEIK | 29274 |
| vlCDR1 | QASQDIGNYLN | 29275 |
| vlCDR2 | YTSRLAS | 29276 |
| vlCDR3 | QQGNTLPYT | 29277 |

Figure 13K
7G8_H3.23_L1.11 (Fab XENP21670)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSS | 29278 |
| vhCDR1 | DAWMD | 29279 |
| vhCDR2 | EISTKANNHATYYAESVKG | 29280 |
| vhCDR3 | LATWDWYFDV | 29281 |
| Variable light (vl) domain | DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK | 29282 |
| vlCDR1 | RASQSVDYDGDSYMN | 29283 |
| vlCDR2 | AASELES | 29284 |
| vlCDR3 | QQSNEDPFT | 29285 |

Figure 13L
7G8_H3.28_L1 (Fab XENP21892)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS | 29286 |
| vhCDR1 | DAWMD | 29287 |
| vhCDR2 | EISTKAYNHATYYAESVKG | 29288 |
| vhCDR3 | LATWDWYFDV | 29289 |
| Variable light (vl) domain | DTVLTQSPSSLSASVGDRVTITCRASQSVDYDGDSYMNWYQQKPGKPPKLLIYAASNLESGIPARLSGSGSGTDFTLTISSLQPEDFATYYCQQSNEDPFTFGSGTKLEIK | 29290 |
| vlCDR1 | RASQSVDYDGDSYMN | 29291 |
| vlCDR2 | AASNLES | 29292 |
| vlCDR3 | QQSNEDPFT | 29293 |

Figure 13M
7G8_H3.28_L1.11 (Fab XENP21893)

| What | sequence | SEQ ID NO: |
|---|---|---|
| Variable heavy (vh) domain | EVQLVESGGGLVQPGGSLRLSCAASGFTFDDAWMDWVRQAPGKGLEWVARISTKAYNHATYYAESVK GRFTISRDDSKSSVYLQMNSLRAEDTAVYYCTRLATWDWYFDVWGQGTTVTVSS | 29294 |
| vhCDR1 | DAWMD | 29295 |
| vhCDR2 | EISTKAYNHATYYAESVKG | 29296 |
| vhCDR3 | LATWDWYFDV | 29297 |
| Variable light (vl) domain | DTVLTQSPSSLSASVGDRVTITCRASQSVDYDGDSYMNWYQQKPGKPPKLLIYAASELESGIPARLS GSGSGTDFTLTISSLQPEDFATYYCQQSNEDPFTFGSGTKLEIK | 29298 |
| vlCDR1 | RASQSVDYDGDSYMN | 29299 |
| vlCDR2 | AASELES | 29300 |
| vlCDR3 | QQSNEDPFT | 29301 |

Figure 13N
7G8_H3.28_L1.13 (Fab XENP21894)

| What | sequence | SEQ ID NO: |
|---|---|---|
| Variable heavy (vh) domain | EVQLVESGGGLVQPGGSLRLSCAASGFTFDDAWMDWVRQAPGKGLEWVARISTKAYNHATYYAESVK GRFTISRDDSKSSVYLQMNSLRAEDTAVYYCTRLATWDWYFDVWGQGTTVTVSS | 29302 |
| vhCDR1 | DAWMD | 29303 |
| vhCDR2 | EISTKAYNHATYYAESVKG | 29304 |
| vhCDR3 | LATWDWYFDV | 29305 |
| Variable light (vl) domain | DTVLTQSPSSLSASVGDRVTITCRASQSVDHDGDSYMNWYQQKPGKPPKLLIYAASELESGIPARLS GSGSGTDFTLTISSLQPEDFATYYCQQSNEDPFTFGSGTKLEIK | 29306 |
| vlCDR1 | RASQSVDHDGDSYMN | 29307 |
| vlCDR2 | AASELES | 29308 |
| vlCDR3 | QQSNEDPFT | 29309 |

Figure 14A (anti-TIM3 variable heavy and light chains + CDRs)

| What: anti-TIM3 XENP21503 1D10_H0L0 | sequence | SEQ ID NO: |
|---|---|---|
| Variable heavy (vh) domain | EVQLVESGGGLVKPGGSLKFSCAASGFAFSSFDMSWVRQTPEKRLEWVAYISSDGASTFYPDTMKGRFTI SRDNAKNTLYLQMSSLKSEDTAMYYCTRLGAYWGQGTLVTVSA | 29310 |
| vhCDR1 | SFDM | 29311 |
| vhCDR2 | YISSDGASTFYPDTMKG | 29312 |
| vhCDR3 | LGAY | 29313 |
| Variable light (vl) domain | DVVMTQTPLTLSVTIGQPASISCKSSQSLLDSDGKTYLNWLLQRPGQSPKRLIYLVSKLDSGVPDRFTGS GSGTDFTIKISRVEAEDLGVYYCWQGTHFPYTFGGGTKLEIK | 29314 |
| vlCDR1 | KSSQSLLDSDGKTYLN | 29315 |
| vlCDR2 | VSKLDS | 29316 |
| vlCDR3 | WQGTHFPYT | 29317 |

Figure 14B

| What: anti-TIM3 XENP21492 1D12_H0L0 | sequence | SEQ ID NO: |
|---|---|---|
| Variable heavy (vh) domain | EVQLVESGGGLVKPGGSLKFSCAASGFAFSSFDMSWVRQTPEKRLEWVAYISSDGASTFYPDTMKGRFTI SRDNAKNTLYLQMSSLKSEDTAMYYCTRLGAYWGQGTLVTVSA | 29318 |
| vhCDR1 | SFDMS | 29319 |
| vhCDR2 | YISSDGASTFYPDTMKG | 29320 |
| vhCDR3 | LGAY | 29321 |
| Variable light (vl) domain | DIVLTQSPASLAVSLGQRATISCRASESVEYYGTSLMQWYQQKPGQPPKLLIYAASNVESGVPARFSGSG SGTDFSLNIHPVEEDDIAMYFCQQSRKVPWTFGGGTKLEIK | 29322 |
| vlCDR1 | RASESVEYYGTSLQ | 29323 |
| vlCDR2 | AASNVES | 29324 |
| vlCDR3 | QQSRKVPWT | 29325 |

Figure 14C (anti-TIM3 variable heavy and light chains + CDRs)

| What: anti-TIM3 XENP21189 3H3_H1L2.1 | sequence | SEQ ID NO: |
|---|---|---|
| Variable heavy (vh) domain | QVTLKESGPVLVKPTETLTLTCTVSGFSLNGYGVNWVRQPPGKGLEWLAMIWGDGSTDYNSALKSRLTIS KDNSKSQVVLTMTNMDPVDTATYYCARSYYTSDEDYWGQGTLVTVSS | 29326 |
| vhCDR1 | GYGVN | 29327 |
| vhCDR2 | MIWGDGSTDYNSALKS | 29328 |
| vhCDR3 | SYYTSDEDY | 29329 |
| Variable light (vl) domain | DIVMTQSPDSLAVSLGERATINCKSSQSLLNSRTRKNYLAWYQQKPGQSPKLLIYWASTRESGVPDRFTG SGSGTDFTLTISSLQAEDVAVYYCKQSYSLRTFGGGTKVEIK | 29330 |
| vlCDR1 | KSSQSLLNSRTRKNYLA | 29331 |
| vlCDR2 | WASTRES | 29332 |
| vlCDR3 | KQSYSLRT | 29333 |

Figure 14D

| What: anti-TIM3 XENP21493 6C8_H0L0 | sequence | SEQ ID NO: |
|---|---|---|
| Variable heavy (vh) domain | QVQLKESGPGLVAPSQSLSITCTVSGFSLNGYGVNWVRQPPGKGLEWLGMIWGDGSTDYNSALKSRLSIS KDNSKSQVFLKMNSLQTDDTARYYCARSYYTSDEDYWGQGTLVTVSA | 29334 |
| vhCDR1 | GYGVN | 29335 |
| vhCDR2 | MIWGDGSTDYNSALKS | 29336 |
| vhCDR3 | SYYTSDEDY | 29337 |
| Variable light (vl) domain | DIVMTQSQKFMSTSVGDRVSVTCKASQNVGSNVAWCQQKPGQSPKALIYSASFRYSGVPDRFTGSGSGTD FTLTISNVQSEDLAEYFCQQYNSYPYTFGGGTKLEIK | 29338 |
| vlCDR1 | KASQNVGSNVA | 29339 |
| vlCDR2 | SASFRYS | 29340 |
| vlCDR3 | QQYNSYPYT | 29341 |

Figure 14E (anti-TIM3 variable heavy and light chains + CDRs)

| What: anti-TIM3 XENP21494 6D9H0_1D12_0 | sequence | SEQ ID NO: |
|---|---|---|
| Variable heavy (vh) domain | QVQLKQSGPGLVQPSQSLSITCTVSGFSLTSYGVHWVRQSPGKGLEWLGVIWSGGSTEYNAAFISRLSIS KDNSKSQVFFKMNSLQADDTAIYYCARGGLLSPFDYWGQGTTLTVSS | 29342 |
| vhCDR1 | SYGVH | 29343 |
| vhCDR2 | VIWSGGSTEYNAAFIS | 29344 |
| vhCDR3 | GGLLSPFDY | 29345 |
| Variable light (vl) domain | DIVLTQSPASLAVSLGQRATISCPASESVEYYGTSLMQWYQQKPGQPPKLLIYAASNVESGVPARFSGSG SGTDFSLNIHPVEEDIAMYFCQQSRKVPWTFGGGTKLEIK | 29346 |
| vlCDR1 | RASESVEYYGTSLMQ | 29347 |
| vlCDR2 | AASNVES | 29348 |
| vlCDR3 | QQSRKVPWT | 29349 |

Figure 14F

| What: anti-TIM3 XENP21495 7A9_H0L0 | sequence | SEQ ID NO: |
|---|---|---|
| Variable heavy (vh) domain | EVKLLESGGGLVQPGGSLKLSCAASGFDFSRYWMSWVRQAPGKGLEWIGEINPDSSTINYTPSLKDKFLI SRDNAKNTLYLQMSKVRSEDTALYYCARFNGYYVGTIFPFAYWGQGTLVTVSA | 29350 |
| vhCDR1 | RYWMS | 29351 |
| vhCDR2 | EINPDSSTINYTPSLKD | 29352 |
| vhCDR3 | FNGYYVGTIFPFAY | 29353 |
| Variable light (vl) domain | QAVVTQESALTTSPGETVTLTCRSSTGAVTTSNYANWVQEKPDHLFTGLIGGTNNRAPGVPARFSGSLIG DKAALTITGAQTEDEAIYFCALWYSNHWVFGGGTKLTVLG | 29354 |
| vlCDR1 | RSSTGAVTTSNYAN | 29355 |
| vlCDR2 | GTNNRAP | 29356 |
| vlCDR3 | ALWYSNHWV | 29357 |

Figure 14G (anti-TIM3 variable heavy and light chains + CDRs)

| What: anti-TIM3 XENP21496 7B11_HOLO | sequence | SEQ ID NO: |
|---|---|---|
| Variable heavy (vh) domain | QVQLKQSGPGLVQPSQSLSITCTVSGFSLTSYAVNWVRQSPGKGLEWLGVIWSGGSTDYNAAFISRLSIS KDNSKSQVFFKMNSLQANDTAIYYCVSLYYRYDGFDYWGQGTLVTVSA | 29358 |
| vhCDR1 | SYAVN | 29359 |
| vhCDR2 | VIWSGGSTDYNAAFIS | 29360 |
| vhCDR3 | LYYRYDGFDY | 29361 |
| Variable light (vl) domain | DIVLTQSQKFLSTSVGDRVSVTCKASQNVGTHVARYQQKPGQSPKALVYSASYRYSGVPDRFTGSGSGTD FTLTISNVQSEDLAEYFCQQYNSYPLTFGGGTKLEIK | 29362 |
| vlCDR1 | KASQNVGTHVA | 29363 |
| vlCDR2 | SASYRYS | 29364 |
| vlCDR3 | QQYNSYPLT | 29365 |

Figure 14H

| What: anti-TIM3 XENP21501 B11var_HOLO | sequence | SEQ ID NO: |
|---|---|---|
| Variable heavy (vh) domain | QVQLKQSGPGLVQPSQSLSITCTVSGFSLTSYAVNWVRQSPGKGLEWLGVIWSGGSTDYNAAFISRLSIS KDNSKSQVFFKMNSLQADDTAIYYCVSLYYRYDGFDYWGQGTLVTVSA | 29366 |
| vhCDR1 | SYAVN | 29367 |
| vhCDR2 | VIWSGGSTDYNAAFIS | 29368 |
| vhCDR3 | LYYRYDGFDY | 29369 |
| Variable light (vl) domain | DIVLTQSQKFLSTSVGDRVSVTCKASQNVGTHVARYQQKPGQSPKALVYSASYRYSGVPDRFTGSGSGTD FTLTISNVQSEDLAEYFCQQYNSYPLTFGGGTKLEIK | 29370 |
| vlCDR1 | KASQNVGTHVA | 29371 |
| vlCDR2 | SASYRYS | 29372 |
| vlCDR3 | QQYNSYPLT | 29373 |

Figure 14I (anti-TIM3 variable heavy and light chains + CDRs)

| What: anti-TIM3 XENP21502 7C2_H0L0 | sequence | SEQ ID NO: |
|---|---|---|
| Variable heavy (vh) domain | EVKVVESGGGLVKPGGSLKLSCAASGFTFSRYAMSWVRQTPEKRLEWVASISSGGSTYYPDSVQGRFTIS RDNARNILYLQMSSLRSEDTAMYYCARGDYEGYFDYWGQGTSLTVSS | 29374 |
| vhCDR1 | RYAMS | 29375 |
| vhCDR2 | SISSGGSTYYPDSVQG | 29376 |
| vhCDR3 | GDYEGYFDY | 29377 |
| Variable light (vl) domain | DIVMTQSPSSLAMSVGQKVTMSCKSSQSLLNSINQKNYLAWYQQKPGQSPKLLVYFASTRESGVPDRFIG SGSGTDFTLTISSVQAEDLADYFCQQHYSTPLTFGAGTKLELK | 29378 |
| vlCDR1 | KSSQSLLNSINQKNYLA | 29379 |
| vlCDR2 | FASTRES | 29380 |
| vlCDR3 | QQHYSTPLT | 29381 |

Figure 15A

XENP016434 YW243.55.S70[PD-L1]_H0L0_IgG1_PVA_/S267K

| What | sequence | SEQ ID NO: |
|---|---|---|
| Variable heavy (vh) domain | EVQLVESGGGLVQPGGSLRLSCAASGFTFSDSWIHWVRQAPGKGLEWVAWISPYGGSTYYADSVKGRFTISADTSKNTAYLQMNSLR AEDTAVYYCARRHWPGGFDYWGQGTLVTVSS | 29382 |
| vhCDR1 | DSWIH | 29383 |
| vhCDR2 | WISPYGGSTYYADSVKG | 29384 |
| vhCDR3 | RHWPGGFDY | 29385 |
| Full length HC | EVQLVESGGGLVQPGGSLRLSCAASGFTFSDSWIHWVRQAPGKGLEWVAWISPYGGSTYYADSVKGRFTISADTSKNTAYLQMNSLR AEDTAVYYCARRHWPGGFDYWGQGTLVTVSS/ASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCPAPPVAGPSVFLFPPKPKDTLMISRTPEVTCVVVD VKHEDPEVKFNWYVDGVEVHNAKTKPREEQYNSTYRVVSVLTVLHQDWLNGKEYKCKVSNKALPAPIEKTISKAKGQPREPQVYTLPP SREEMTKNQVSLTCLVKGFYPSDIAVEWESNGQPENNYKTTPPVLDSDGSFFLYSKLTVDKSRWQQGNVFSCSVMHEALHNHYTQKS LSLSPGK | 29386 |
| Variable light (vl) domain | DIQMTQSPSSLSASVGDRVTITCRASQDVSTAVAWYQQKPGKAPKLLIYSASFLYSGVPSRFSGSGSGTDFTLTISSLQPEDFATYYCQQY LYHPATFGQGTKVEIK | 29387 |
| vlCDR1 | RASQDVSTAVA | 29388 |
| vlCDR2 | SASFLYS | 29389 |
| vlCDR3 | QQYLYHPAT | 29390 |
| Full length light chain | DIQMTQSPSSLSASVGDRVTITCRASQDVSTAVAWYQQKPGKAPKLLIYSASFLYSGVPSRFSGSGSGTDFTLTISSLQPEDFATYYCQQY LYHPATFGQGTKVEIK/RTVAAPSVFIFPPSDEQLKSGTASVVCLLNNFYPREAKVQWKVDNALQSGNSQESVTEQDSKDSTYSLSSTLT LSKADYEKHKVYACEVTHQGLSSPVTKSFNRGEC | 29391 |

Figure 15B

XENP024118 avelumab[PD-L1]_H1L1_IgG1_PVA_/S267K

| What | sequence | SEQ ID NO: |
|---|---|---|
| Variable heavy (vh) domain | EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS | 29392 |
| vhCDR1 | SYIMM | 29393 |
| vhCDR2 | SIYPSGGITFYADTVKG | 29394 |
| vhCDR3 | IKLGTVTTVDY | 29395 |
| Full length HC | EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 29396 |
| Variable light (vl) domain | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 29397 |
| vlCDR1 | TGTSSDVGGYNYVS | 29398 |
| vlCDR2 | DVSNRPS | 29399 |
| vlCDR3 | SSYTSSSTRV | 29400 |
| Full length light chain | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL/GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 29401 |

Figure 15C

XENP024119 durvalumab[PD-L1]_H1L1_IgG1_PVA_/S267K

| What | sequence | SEQ ID NO: |
|---|---|---|
| Variable heavy (vh) domain | EVQLVESGGGLVQPGGSLRLSCAASGFTFSRYWMSWVRQAPGKGLEWVANIKQDGSEKYYVDSVKGRFTISRDNAKNSLYLQMNSL RAEDTAVYYCAREGGWFGELAFDYWGQGTLVTVSS | 29402 |
| vhCDR1 | RYWMS | 29403 |
| vhCDR2 | NIKQDGSEKYYVDSVKG | 29404 |
| vhCDR3 | EGGWFGELAFDY | 29405 |
| Full length HC | EVQLVESGGGLVQPGGSLRLSCAASGFTFSRYWMSWVRQAPGKGLEWVANIKQDGSEKYYVDSVKGRFTISRDNAKNSLYLQMNSL RAEDTAVYYCAREGGWFGELAFDYWGQGTLVTVSS/ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKKVEPKSCDKTHTCPPCPAPPVAGPSVFLFPPKPKDTLMISRTPEVTC VVVDVKHEDPEVKFNWYVDGVEVHNAKTKPREEQYNSTYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSVMHEALHNH YTQKSLSLSPGK | 29406 |
| Variable light (vl) domain | EIVLTQSPGTLSLSPGERATLSCRASQRVSSSYLAWYQQKPGQAPRLLIYDASSRATGIPDRFSGSGSGTDFTLTISRLEPEDFAVYYCQQY GSLPWTFGQGTKVEIK | 29407 |
| vlCDR1 | RASQRVSSSYLA | 29408 |
| vlCDR2 | DASSRAT | 29409 |
| vlCDR3 | QQYGSLPWT | 29410 |
| Full length light chain | EIVLTQSPGTLSLSPGERATLSCRASQRVSSSYLAWYQQKPGQAPRLLIYDASSRATGIPDRFSGSGSGTDFTLTISRLEPEDFAVYYCQQY GSLPWTFGQGTKVEIK/RTVAAPSVFIFPPSDEQLKSGTASVVCLLNNFYPREAKVQWKVDNALQSGNSQESVTEQDSKDSTYSLSSTLT LSKADYEKHKVYACEVTHQGLSSPVTKSFNRGEC | 29411 |

Figure 16

XENP014410 20H4.9[4-1BB]_H0L0_IgG1_PVA_/S267K

| What | sequence | SEQ ID NO: |
|---|---|---|
| Variable heavy (vh) domain | QVQLQQWGAGLLKPSETLSLTCAVYGGSFSGYYWSWIRQSPEKGLEWIGEINHGGYVTYNPSLESRVTISVDTSKNQFSLKLSSVTAAD TAVYYCARDYGPGNYDWYFDLWGRGTLVTVSS | 29412 |
| vhCDR1 | GYYWS | 29413 |
| vhCDR2 | EINHGGYVTYNPSLES | 29414 |
| vhCDR3 | DYGPGNYDWYFDL | 29415 |
| Full length HC | QVQLQQWGAGLLKPSETLSLTCAVYGGSFSGYYWSWIRQSPEKGLEWIGEINHGGYVTYNPSLESRVTISVDTSKNQFSLKLSSVTAAD TAVYYCARDYGPGNYDWYFDLWGRGTLVTVSSASTKGPSVFPLAPSSKSTSGGTAALGCLVKDYFPEPVTVSWNSGALTSGVHTFPA VLQSSGLYSLSSVVTVPSSSLGTQTYICNVNHKPSNTKVDKKVEPKSCDKTHTCPPCPAPPVAGPSVFLFPPKPKDTLMISRTPEVTCVVV DVKHEDPEVKFNWYVDGVEVHNAKTKPREEQYNSTYRVVSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK | 29416 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVYYCQQRS NWPPALTFGGGTKVEIK | 29417 |
| vlCDR1 | RASQSVSSYLA | 29418 |
| vlCDR2 | DASNRAT | 29419 |
| vlCDR3 | QQRSNWPPALT | 29420 |
| Full length light chain | EIVLTQSPATLSLSPGERATLSCRASQSVSSYLAWYQQKPGQAPRLLIYDASNRATGIPARFSGSGSGTDFTLTISSLEPEDFAVYYCQQRS NWPPALTFGGGTKVEIKRTVAAPSVFIFPPSDEQLKSGTASVVCLLNNFYPREAKVQWKVDNALQSGNSQESVTEQDSKDSTYSLSST LTLSKADYEKHKVYACEVTHQGLSSPVTKSFNRGEC | 29421 |

Figure 17

XENP016437 11D4[OX40]_H0L0_IgG1_PVA_/5267K

| What | sequence | SEQ ID NO: |
|---|---|---|
| Variable heavy (vh) domain | EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS | 29422 |
| vhCDR1 | SYSMN | 29423 |
| vhCDR2 | YISSSSTIDYADSVKG | 29424 |
| vhCDR3 | ESGWYLFDY | 29425 |
| Full length HC | EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 29426 |
| Variable light (vl) domain | DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK | 29427 |
| vlCDR1 | RASQGISSWLA | 29428 |
| vlCDR2 | AASSLQS | 29429 |
| vlCDR3 | QQYNSYPPT | 29430 |
| Full length light chain | DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 29431 |

Figure 18

XENP016438 1D8[GITR]_H0L0_IgG1_PVA_/S267K

| What | sequence | SEQ ID NO: |
|---|---|---|
| Variable heavy (vh) domain | QVTLKESGPGILKPSQTLSLTCSFSGFSLSTSGMGVGWIRQPSGKGLEWLAHIWWDDDKYYSPSLKSQLTISKDTSRNQVFLKITSLDTA DTATYYCVRSYYYGSSGAMDYWGQGTSVTVSS | 29432 |
| vhCDR1 | TSGMGVG | 29433 |
| vhCDR2 | HIWWDDDKYYSPSLKS | 29434 |
| vhCDR3 | SYYYGSSGAMDY | 29435 |
| Full length HC | QVTLKESGPGILKPSQTLSLTCSFSGFSLSTSGMGVGWIRQPSGKGLEWLAHIWWDDDKYYSPSLKSQLTISKDTSRNQVFLKITSLDTA DTATYYCVRSYYYGSSGAMDYWGQGTSVTVSS/ASTKGPSVFPLAPSSKSTSGGTAALGCLVKDYFPEPVTVSWNSGALTSGVHTFPA VLQSSGLYSLSSVVTVPSSSLGTQTYICNVNHKPSNTKVDKKVEPKSCDKTHTCPPCPAPPVAGPSVFLFPPKPKDTLMISRTPEVTCVVV DVKHEDPEVKFNWYVDGVEVHNAKTKPREEQYNSTYRVVSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK | 29436 |
| Variable light (vl) domain | DIVMTQTPLSLPVSLGDQASISCRSSQSLVHSDGNTYLHWYLQKPGQSPKLLIYKVSKRFSGVPDRFSGSGSGTDFTLKISRVEAEDLGVY FCSQSTHVPPTFGGGTKLEIK | 29437 |
| vlCDR1 | RSSQSLVHSDGNTYLH | 29438 |
| vlCDR2 | KVSKRFS | 29439 |
| vlCDR3 | SQSTHVPPT | 29440 |
| Full length light chain | DIVMTQTPLSLPVSLGDQASISCRSSQSLVHSDGNTYLHWYLQKPGQSPKLLIYKVSKRFSGVPDRFSGSGSGTDFTLKISRVEAEDLGVY FCSQSTHVPPTFGGGTKLEIK/RTVAAPSVFIFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC | 29441 |

Figure 19A

XENP016435 [anti-ICOS]_H0L0_IgG1_PVA_/S267K

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYHDAFDIWGQGTMVTVSS | 29442 |
| vhCDR1 | GYYMH | 29443 |
| vhCDR2 | WINPHSGGTNYAQKFQG | 29444 |
| vhCDR3 | TYYDSSGYYHDAFDI | 29445 |
| Full length HC | QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYHDAFDIWGQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 29446 |
| Variable light (vl) domain | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK | 29447 |
| vlCDR1 | RASQGISRLLA | 29448 |
| vlCDR2 | VASSLQS | 29449 |
| vlCDR3 | QQANSFPWT | 29450 |
| Full length light chain | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 29451 |

Figure 19B

XENP021820 GSK_314.8[IC0S]_H0L0_IgG1_PVA_/S267K

| What | sequence | SEQ ID NO: |
|---|---|---|
| Variable heavy (vh) domain | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVST | 29452 |
| vhCDR1 | TYWMH | 29453 |
| vhCDR2 | EIDPSDSYVNYNQNFKG | 29454 |
| vhCDR3 | SPDYYGTSLAWFDY | 29455 |
| Full length HC | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVST/ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKKVEPKSCDKTHTCPPCPAPPVAGPSVFLFPPKPKDTLMISRTPEVTC VVVDVKHEDPEVKFNWYVDGVEVHNAKTKPREEQYNSTYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSVMHEALHNH YTQKSLSLSPGK | 29456 |
| Variable light (vl) domain | DIVMTQAAPSVPVTPGESVSISCRSSKSPLHSNGNIYLYWFLQRPGQSPQLLIYRMSNLASGVPDRFSGSGSGTTFTLKISRVEAEDVGV YYCMQHLEYPYTFGGGTKLEIK | 29457 |
| vlCDR1 | RSSKSPLHSNGNIYLY | 29458 |
| vlCDR2 | RMSNLAS | 29459 |
| vlCDR3 | MQHLEYPYT | 29460 |
| Full length light chain | DIVMTQAAPSVPVTPGESVSISCRSSKSPLHSNGNIYLYWFLQRPGQSPQLLIYRMSNLASGVPDRFSGSGSGTTFTLKISRVEAEDVGV YYCMQHLEYPYTFGGGTKLEIK/RTVAAPSVFIFPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC | 29461 |

Figure 19C

XENP021821 GSK_88.2[ICOS]_H0L0_IgG1_PVA_/S267K

| What | sequence | SEQ ID NO: |
|---|---|---|
| Variable heavy (vh) domain | QVQLQQPGAELVRPGASVKLSCKASGYSFTSYWINWVKQRPGQGLEWIGNIYPSDSYTNYNQMFKDKATLTVDKSSNTAYMQLTSP TSEDSAVYYCTRWNLSYFDNNYYLDYWGQGTTLTVSS | 29462 |
| vhCDR1 | SYWIN | 29463 |
| vhCDR2 | NIYPSDSYTNYNQMFKD | 29464 |
| vhCDR3 | WNLSYYFDNNYYLDY | 29465 |
| Full length HC | QVQLQQPGAELVRPGASVKLSCKASGYSFTSYWINWVKQRPGQGLEWIGNIYPSDSYTNYNQMFKDKATLTVDKSSNTAYMQLTSP TSEDSAVYYCTRWNLSYFDNNYYLDYWGQGTTLTVSS/ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEPKSCDKTHTCPPCPAPPVAGPSVFLFPPKPKDTLMISRTPEV TCVVVDVKHEDPEVKFNWYVDGVEVHNAKTKPREEQYNSTYRVVSVLTVLHQDWLNGKEYKCKVSNKALPAPIEKTISKAKGQPREP QVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK | 29466 |
| Variable light (vl) domain | DIVMTQAAPSVPVTPGESVSISCRSSKSLLHSNGNTYLYWFLQRPGQSPQLLIYRMSNLASGVPDRFSGSGSGTAFTLRISRVEAEDVGV YCMQHLEYPWTFGGGTKLEIK | 29467 |
| vlCDR1 | RSSKSLLHSNGNTYLY | 29468 |
| vlCDR2 | RMSNLAS | 29469 |
| vlCDR3 | MQHLEYPWT | 29470 |
| Full length light chain | DIVMTQAAPSVPVTPGESVSISCRSSKSLLHSNGNTYLYWFLQRPGQSPQLLIYRMSNLASGVPDRFSGSGSGTAFTLRISRVEAEDVGV YCMQHLEYPWTFGGGTKLEIK/RTVAAPSVFIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC | 29471 |

Figure 19D

XENP021822 jMab-138[ICOS]_H0L0_IgG1_PVA_/S267K

| What | sequence | SEQ ID NO: |
|---|---|---|
| Variable heavy (vh) domain | EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDNRKVTHEHYYYGMDVWGQGTTVTVSS | 29472 |
| vhCDR1 | SYDMH | 29473 |
| vhCDR2 | AIGTAGDTYYPGSVKG | 29474 |
| vhCDR3 | DNRKVTHEHYYYGMDV | 29475 |
| Full length HC | EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDNRKVTHEHYYYGMDVWGQGTTVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 29476 |
| Variable light (vl) domain | EIVLTQSPGTLSLSPGERATLSCRASQNIRSSYLAWYQQKPGQAPGLLIYGASSRATGIPDRFSGSGSGTDFTLTISRLEPEDFAVYYCQQFGSSPMCSFGQGTKLEIK | 29477 |
| vlCDR1 | RASQNIRSSYLA | 29478 |
| vlCDR2 | GASSRAT | 29479 |
| vlCDR3 | QQFGSSPMCS | 29480 |
| Full length light chain | EIVLTQSPGTLSLSPGERATLSCRASQNIRSSYLAWYQQKPGQAPGLLIYGASSRATGIPDRFSGSGSGTDFTLTISRLEPEDFAVYYCQQFGSSPMCSFGQGTKLEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 29481 |

Figure 19E

XENP021823 jMab-139[ICOS]_H0L0_IgG1_PVA_/S267K

| What | sequence | SEQ ID NO: |
|---|---|---|
| Variable heavy (vh) domain | EVQLVESGGGLVQPGGSLRLSCAASGFTFSSYDMHWVRQATGKGLEWVSAIGTAGDTYYPGSVKGRFTISRENAKNSLYLQMNSLRA GDTAVYYCVRDKRTVTHEHYYYYGMDVWGQGTTVTVSS | 29482 |
| vhCDR1 | SYDMH | 29483 |
| vhCDR2 | AIGTAGDTYYPGSVKG | 29484 |
| vhCDR3 | DKRTVTHEHYYYYGMDV | 29485 |
| Full length HC | EVQLVESGGGLVQPGGSLRLSCAASGFTFSSYDMHWVRQATGKGLEWVSAIGTAGDTYYPGSVKGRFTISRENAKNSLYLQMNSLRA GDTAVYYCVRDKRTVTHEHYYYYGMDVWGQGTTVTVSS/ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEPKSCDKTHTCPPCPAPPVAGPSVFLFPPKPKDTLMISRTPE VTCVVVDVKHEDPEVKFNWYVDGVEVHNAKTKPREEQYNSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTPPVLDSDGSFFLYSKLTVDKSRWQQGNVFSCSVMHEAL HNHYTQKSLSLSPGK | 29486 |
| Variable light (vl) domain | EIVLTQSPGTLSLSPGERATLSCRASQSISSSLAWYQQKPGQAPGLLIFGASSRATGIPDRFSGSGSGTDFTLTISRLEPEDFAVYYCQQF GSSPMCSFGQGTKLEIK | 29487 |
| vlCDR1 | RASQSISSSLA | 29488 |
| vlCDR2 | GASSRAT | 29489 |
| vlCDR3 | QQFGSSPMCS | 29490 |
| Full length light chain | EIVLTQSPGTLSLSPGERATLSCRASQSISSSLAWYQQKPGQAPGLLIFGASSRATGIPDRFSGSGSGTDFTLTISRLEPEDFAVYYCQQF GSSPMCSFGQGTKLEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 29491 |

Figure 19F

XENP022346 WO2016059602_GSK[ICOS]_H0L0_IgG1_PVA_/S267K

| What | sequence | SEQ ID NO: |
|---|---|---|
| Variable heavy (vh) domain | QVQLVQSGAEVKKPGSSVKVSCKASGYTFTDYAMHWVRQAPGQGLEWMGLISIYSDHTNYNQKFQGRVTITADKSTSTAYMELSSLR SEDTAVYYCGRNNYGNYGWYFDVWGQGTTVTVSS | 29492 |
| vhCDR1 | DYAMH | 29493 |
| vhCDR2 | LISIYSDHTNYNQKFQG | 29494 |
| vhCDR3 | NNYGNYGWYFDV | 29495 |
| Full length HC | QVQLVQSGAEVKKPGSSVKVSCKASGYTFTDYAMHWVRQAPGQGLEWMGLISIYSDHTNYNQKFQGRVTITADKSTSTAYMELSSLR SEDTAVYYCGRNNYGNYGWYFDVWGQGTTVTVSS/ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKKVEPKSCDKTHTCPPCPAPPVAGPSVFLFPPKPKDTLMISRTPEVTC VVVDVSHEDPEVKFNWYVDGVEVHNAKTKPREEQYNSTYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSVMHEALHNH YTQKSLSLSPGK | 29496 |
| Variable light (vl) domain | EIVLTQSPATLSLSPGERATLSCCASSSVSYMHWYQQKPGQAPRLLIYDTSKLASGIPARFSGSGSGTDYTLTISSLEPEDFAVYYCFQGSG YPYTFGQGTKLEIK | 29497 |
| vlCDR1 | SASSSVSYMH | 29498 |
| vlCDR2 | DTSKLAS | 29499 |
| vlCDR3 | FQGSGYPYT | 29500 |
| Full length light chain | EIVLTQSPATLSLSPGERATLSCCASSSVSYMHWYQQKPGQAPRLLIYDTSKLASGIPARFSGSGSGTDYTLTISSLEPEDFAVYYCFQGSG YPYTFGQGTKLEIK/RTVAAPSVFIFPPSDEQLKSGTASVVCLLNNFYPREAKVQWKVDNALQSGNSQESVTEQDSKDSTYSLSSTLTLSK ADYEKHKVYACEVTHQGLSSPVTKSFNRGEC | 29501 |

Figure 19G

XENP023057 Jounce_37A10S713[COS]_H0L0_IgG1_PVA_/S267K

| What | sequence | SEQ ID NO: |
|---|---|---|
| Variable heavy (vh) domain | EVQLVESGGGLVQPGGSLRLSCAASGFTFSDYWMDWVRQAPGKGLVWVSNIDEDGSITEYSPFVKGRFTISRDNAKNTLYLQMNSLR AEDTAVYYCTRWGRFGFDSWGQGTLVTVSS | 29502 |
| vhCDR1 | DYWMD | 29503 |
| vhCDR2 | NIDEDGSITEYSPFVKG | 29504 |
| vhCDR3 | WGRFGFDS | 29505 |
| Full length HC | EVQLVESGGGLVQPGGSLRLSCAASGFTFSDYWMDWVRQAPGKGLVWVSNIDEDGSITEYSPFVKGRFTISRDNAKNTLYLQMNSLR AEDTAVYYCTRWGRFGFDSWGQGTLVTVSS/ASTKGPSVFPLAPSSKSTSGGTAALGCLVKDYFPEPVTVSWNSGALTSGVHTFPAVL QSSGLYSLSSVVTVPSSSLGTQTYICNVNHKPSNTKVDKKVEPKSCDKTHTCPPCPAPPVAGPSVFLFPPKPKDTLMISRTPEVTCVVVDV KHEDPEVKFNWYVDGVEVHNAKTKPREEQYNSTYRVVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALHNHYTQKSL SLSPGK | 29506 |
| Variable light (vl) domain | DIVMTQSPDSLAVSLGERATINCKSSQSLLSGSFNYLTWYQQKPGQPPKLLIFYASTRHTGVPDRFSGSGSGTDFTLTISSLQAEDVAVYY CHHHYNAPPTFGPGTKVDIK | 29507 |
| vlCDR1 | KSSQSLLSGSFNYLT | 29508 |
| vlCDR2 | YASTRHT | 29509 |
| vlCDR3 | HHHYNAPPT | 29510 |
| Full length light chain | DIVMTQSPDSLAVSLGERATINCKSSQSLLSGSFNYLTWYQQKPGQPPKLLIFYASTRHTGVPDRFSGSGSGTDFTLTISSLQAEDVAVYY CHHHYNAPPTFGPGTKVDIK/RTVAAPSVFIFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC | 29511 |

Figure 20A

XENP022091 [ICOS]_H0_L0.7_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29512 |
| vhCDR1 | GYYMH | 29513 |
| vhCDR2 | WINPHSGGTNYAQKFQG | 29514 |
| vhCDR3 | TYYYDSSGYYHDAFDI | 29515 |
| Full length HC | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCGS | 29516 |
| Variable light (vl) domain | DIQMTQSPSSVSASVGDRVTITCRASQGISSYLAWYQQKPGKAPKLLIYVASSLQSGVPSRFSGSGSGTDFTLTISSLQPEDFATYYCQQA NSFPWTFGQGTKVEIK | 29517 |
| vlCDR1 | RASQGISSYLA | 29518 |
| vlCDR2 | VASSLQS | 29519 |
| vlCDR3 | QQANSFPWT | 29520 |
| Full length light chain | DIQMTQSPSSVSASVGDRVTITCRASQGISSYLAWYQQKPGKAPKLLIYVASSLQSGVPSRFSGSGSGTDFTLTISSLQPEDFATYYCQQA NSFPWTFGQGTKVEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 29521 |

Figure 20B

XENP022780 [ICOS]_H0_L0.34_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29522 |
| vhCDR1 | GYYMH | 29523 |
| vhCDR2 | WINPHSGGTNYAQKFQG | 29524 |
| vhCDR3 | TYYYDSSGYYHDAFDI | 29525 |
| Full length HC | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCGS | 29526 |
| Variable light (vl) domain | DIQMTQSPSSVSASVGDRVTITCQASQDISRLLAWYQQKPGKAPKLLIYVASSLQSGVPSRFSGSGSGTDFTLTISSLQPEDFATYYCQQ AESFPWTFGQGTKVEIK | 29527 |
| vlCDR1 | QASQDISRLLA | 29528 |
| vlCDR2 | VASSLQS | 29529 |
| vlCDR3 | QQAESFPWT | 29530 |
| Full length light chain | DIQMTQSPSSVSASVGDRVTITCQASQDISRLLAWYQQKPGKAPKLLIYVASSLQSGVPSRFSGSGSGTDFTLTISSLQPEDFATYYCQQ AESFPWTFGQGTKVEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 29531 |

Figure 20C

XENP022782 [ICOS]_H0_L0.36_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29532 |
| vhCDR1 | GYYMH | 29533 |
| vhCDR2 | WINPHSGGTNYAQKFQG | 29534 |
| vhCDR3 | TYYYDSSGYYHDAFDI | 29535 |
| Full length HC | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCGS | 29536 |
| Variable light (vl) domain | DIQMTQSPSSVSASVGDRVTITCQASQDISSLLAWYQQKPGKAPKLLIYVASSLQSGVPSRFSGSGSGTDFTLTISSLQPEDFATYYCQQA ESFPWTFGQGTKVEIK | 29537 |
| vlCDR1 | QASQDISSLLA | 29538 |
| vlCDR2 | VASSLQS | 29539 |
| vlCDR3 | QQAESFPWT | 29540 |
| Full length light chain | DIQMTQSPSSVSASVGDRVTITCQASQDISSLLAWYQQKPGKAPKLLIYVASSLQSGVPSRFSGSGSGTDFTLTISSLQPEDFATYYCQQA ESFPWTFGQGTKVEIK/RTVAAPSVFIFPPSDEQLKSGTASVVCLLNNFYPREAKVQWKVDNALQSGNSQESVTEQDSKDSTYSLSSTLT LSKADYEKHKVYACEVTHQGLSSPVTKSFNRGEC | 29541 |

Figure 20D

XENP022783 [ICOS]_H0_L0.37_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29542 |
| vhCDR1 | GYYMH | 29543 |
| vhCDR2 | WINPHSGGTNYAQKFQG | 29544 |
| vhCDR3 | TYYYDSSGYYHDAFDI | 29545 |
| Full length HC | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCGS | 29546 |
| Variable light (vl) domain | DIQMTQSPSSVSASVGDRVTITCQASQDISRLLAWYQQKPGKAPKLLIYAASSLQSGVPSRFSGSGSGTDFTLTISSLQPEDFATYYCQQ AESFPWTFGQGTKVEIK | 29547 |
| vlCDR1 | QASQDISRLLA | 29548 |
| vlCDR2 | AASSLQS | 29549 |
| vlCDR3 | QQAESFPWT | 29550 |
| Full length light chain | DIQMTQSPSSVSASVGDRVTITCQASQDISRLLAWYQQKPGKAPKLLIYAASSLQSGVPSRFSGSGSGTDFTLTISSLQPEDFATYYCQQ AESFPWTFGQGTKVEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 29551 |

Figure 20E

XENP022784 [ICOS]_H0_L0.38_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29552 |
| vhCDR1 | GYYMH | 29553 |
| vhCDR2 | WINPHSGGTNYAQKFQG | 29554 |
| vhCDR3 | TYYYDSSGYYHDAFDI | 29555 |
| Full length HC | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCGS | 29556 |
| Variable light (vl) domain | DIQMTQSPSSVSASVGDRVTITCQASQDISSLLAWYQQKPGKAPKLLIYAASSLQSGVPSRFSGSGSGTDFTLTISSLQPEDFATYCQQ AESFPWTFGQGTKVEIK | 29557 |
| vlCDR1 | QASQDISSLLA | 29558 |
| vlCDR2 | AASSLQS | 29559 |
| vlCDR3 | QQAESFPWT | 29560 |
| Full length light chain | DIQMTQSPSSVSASVGDRVTITCQASQDISSLLAWYQQKPGKAPKLLIYAASSLQSGVPSRFSGSGSGTDFTLTISSLQPEDFATYCQQ AESFPWTFGQGTKVEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 29561 |

Figure 20F

XENP023088 [ICOS]_H0.66_L0_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS | 29562 |
| vhCDR1 | GYYMH | 29563 |
| vhCDR2 | WINPHSGETIYAQKFQG | 29564 |
| vhCDR3 | TYYYDTSGYYHDAFDV | 29565 |
| Full length HC | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS | 29566 |
| Variable light (vl) domain | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK | 29567 |
| vlCDR1 | RASQGISRLLA | 29568 |
| vlCDR2 | VASSLQS | 29569 |
| vlCDR3 | QQANSFPWT | 29570 |
| Full length light chain | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 29571 |

Figure 206

XENP023409 [ICOS]_H0.66_L0.34_Fab

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS | 29572 |
| vhCDR1 | GYYMH | 29573 |
| vhCDR2 | WINPHSGETIYAQKFQG | 29574 |
| vhCDR3 | TYYYDTSGYYHDAFDV | 29575 |
| Full length HC | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS | 29576 |
| Variable light (vl) domain | DIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK | 29577 |
| vlCDR1 | QASQDISRLLA | 29578 |
| vlCDR2 | VASSLQS | 29579 |
| vlCDR3 | QQAESFPWT | 29580 |
| Full length light chain | DIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 29581 |

Figure 21A

| XENP | $T_m$ (°C) | $\Delta T_m$ (°C) |
|---|---|---|
| 22050 | 72 | 0 |
| 22051 | 72.5 | 0.5 |
| 22052 | 72 | 0 |
| 22053 | 70.5 | -1.5 |
| 22054 | 72 | 0 |
| 22055 | 72 | 0 |
| 22056 | 70.5 | -1.5 |
| 22057 | 72.5 | 0.5 |
| 22058 | 71.5 | -0.5 |
| 22059 | 71.5 | -0.5 |
| 22060 | 71.5 | -0.5 |
| 22061 | 70.5 | -1.5 |
| 22062 | 72.5 | 0.5 |
| 22063 | 68 | -4 |
| 22064 | 71.5 | -0.5 |
| 22065 | 70.5 | -1.5 |
| 22066 | 71 | -1 |
| 22067 | 71.5 | -0.5 |
| 22068 | 71 | -1 |
| 22069 | 72.5 | 0.5 |
| 22070 | 73 | 1 |
| 22071 | 73 | 1 |
| 22072 | 73 | 1 |
| 22073 | 72.5 | 0.5 |
| 22074 | 71 | -1 |
| 22075 | 66.5 | -5.5 |
| 22076 | 71.5 | -0.5 |
| 22077 | 70.5 | -1.5 |
| 22078 | 70 | -2 |
| 22079 | 74.5 | 2.5 |
| 22080 | 73.5 | 1.5 |
| 22081 | 73 | 1 |
| 22082 | 75.5 | 3.5 |
| 22083 | 76 | 4 |
| 22084 | 72 | 0 |
| 22085 | 71 | -1 |
| 22086 | 70 | -2 |
| 22087 | 74 | 2 |
| 22088 | 73 | 1 |
| 22089 | 70.5 | -1.5 |
| 22090 | 70 | -2 |
| 22091 | 72.5 | 0.5 |

Figure 21B

| | | |
|---|---|---|
| 22092 | 71 | -1 |
| 22093 | 73 | 1 |
| 22094 | 74.5 | 2.5 |
| 22095 | 74 | 2 |
| 22096 | 72 | 0 |
| 22101 | 70 | -2 |
| 22102 | 72 | 0 |
| 22103 | 71.5 | -0.5 |
| 22104 | 73 | 1 |
| 22106 | 71 | -1 |
| 22107 | 68.5 | -3.5 |
| 22108 | 71.5 | -0.5 |
| 22767 | 74 | 2 |
| 22768 | 76.5 | 4.5 |
| 22769 | 74.5 | 2.5 |
| 22771 | 71 | -1 |
| 22772 | 75 | 3 |
| 22773 | 75.5 | 3.5 |
| 22774 | 73 | 1 |
| 22775 | 76 | 4 |
| 22776 | 73.5 | 1.5 |
| 22777 | 75 | 3 |
| 22778 | 73 | 1 |
| 22779 | 76 | 4 |
| 22780 | 73 | 1 |
| 22781 | 75 | 3 |
| 22782 | 72.5 | 0.5 |
| 22783 | 75.5 | 3.5 |
| 22784 | 74.5 | 2.5 |
| 22861 | 76 | 4 |
| 22862 | 76 | 4 |
| 22863 | 75.5 | 3.5 |
| 22938 | 75.5 | 3.5 |
| 22939 | 76.5 | 4.5 |
| 22940 | 78.5 | 6.5 |
| 22941 | 76.5 | 4.5 |
| 22944 | 74 | 2 |
| 22945 | 76 | 4 |
| 22946 | 76.5 | 4.5 |
| 23086 | 72.5 | 0.5 |
| 23087 | 68 | -4 |
| 23088 | 73.5 | 1.5 |
| 23089 | 69 | -3 |
| 23409 | 74.5 | 2.5 |

Figure 22A

| XENP | Antigen | $K_D$ (nM) | $k_a$ (1/Ms) | $k_d$ (1/s) |
|---|---|---|---|---|
| 22050 | huICOS | 3.538 | 5.04E+04 | 1.79E-04 |
| 22051 | huICOS | 798.8 | 7.99E+02 | 6.38E-04 |
| 22052 | huICOS | <0.001 | 3.32E+04 | <1.0E-07 |
| 22053 | huICOS | 13.85 | 1.09E+05 | 1.52E-03 |
| 22054 | huICOS | <0.001 | 4.65E+04 | <1.0E-07 |
| 22055 | huICOS | 1.725 | 9.15E+04 | 1.58E-04 |
| 22056 | huICOS | 3.765 | 4.54E+04 | 1.71E-04 |
| 22057 | huICOS | 13.19 | 3.10E+04 | 4.09E-04 |
| 22058 | huICOS | 2.69 | 3.17E+04 | 8.52E-05 |
| 22059 | huICOS | 2.289 | 1.04E+05 | 2.38E-04 |
| 22060 | huICOS | 3.361 | 6.48E+04 | 2.18E-04 |
| 22061 | huICOS | 2.373 | 8.81E+04 | 2.09E-04 |
| 22062 | huICOS | 2.442 | 4.94E+04 | 1.21E-04 |
| 22063 | huICOS | 4.835 | 6.80E+04 | 3.29E-04 |
| 22064 | huICOS | 5.521 | 4.03E+04 | 2.23E-04 |
| 22065 | huICOS | 3.605 | 9.15E+04 | 3.30E-04 |
| 22066 | huICOS | 1.073 | 1.76E+04 | 1.89E-05 |
| 22067 | huICOS | 2.187 | 7.67E+04 | 1.68E-04 |
| 22068 | huICOS | 3.329 | 3.45E+04 | 1.15E-04 |
| 22069 | huICOS | <0.001 | 2.00E+04 | <1.0E-07 |
| 22070 | huICOS | very weak | very weak | very weak |
| 22071 | huICOS | <0.001 | 2.19E+04 | <1.0E-07 |
| 22072 | huICOS | <0.001 | 2.17E+04 | <1.0E-07 |
| 22073 | huICOS | 171.8 | 2.43E+03 | 4.17E-04 |
| 22074 | huICOS | <0.001 | 2.04E+04 | <1.0E-07 |
| 22075 | huICOS | very weak | very weak | very weak |
| 22076 | huICOS | very weak | very weak | very weak |
| 22077 | huICOS | 9.747 | 4.71E+04 | 4.59E-04 |
| 22078 | huICOS | 117 | 1.81E+03 | 2.12E-04 |
| 22079 | huICOS | very weak | very weak | very weak |
| 22080 | huICOS | very weak | very weak | very weak |
| 22081 | huICOS | very weak | very weak | very weak |
| 22082 | huICOS | very weak | very weak | very weak |
| 22083 | huICOS | very weak | very weak | very weak |
| 22084 | huICOS | 2.411 | 9.50E+04 | 2.29E-04 |
| 22085 | huICOS | 1.785 | 9.63E+04 | 1.72E-04 |
| 22086 | huICOS | <0.001 | 4.84E+04 | <1.0E-07 |
| 22087 | huICOS | 0.9926 | 8.66E+04 | 8.59E-05 |
| 22088 | huICOS | 0.606 | 9.51E+04 | 5.77E-05 |
| 22089 | huICOS | 5.14 | 8.77E+04 | 4.51E-04 |
| 22090 | huICOS | very weak | very weak | very weak |

Figure 22B

| XENP | Antigen | $K_D$ (nM) | $k_a$ (1/Ms) | $k_d$ (1/s) |
|---|---|---|---|---|
| 22091 | huICOS | 51.33 | 3.29E+04 | 1.69E-03 |
| 22092 | huICOS | 70.14 | 7.93E+04 | 5.56E-03 |
| 22093 | huICOS | 19.27 | 3.47E+04 | 6.68E-04 |
| 22094 | huICOS | 32.62 | 2.80E+04 | 9.13E-04 |
| 22095 | huICOS | 3.472 | 1.24E+05 | 4.31E-04 |
| 22096 | huICOS | 3.023 | 8.14E+04 | 2.46E-04 |
| 22101 | huICOS | 2.61 | 6.08E+04 | 1.59E-04 |
| 22102 | huICOS | 4.746 | 1.00E+05 | 4.77E-04 |
| 22103 | huICOS | 5.838 | 4.94E+04 | 2.89E-04 |
| 22104 | huICOS | 3.862 | 7.78E+04 | 3.01E-04 |
| 22105 | huICOS | 2.49 | 9.40E+04 | 2.34E-04 |
| 22106 | huICOS | 3.446 | 6.62E+04 | 2.28E-04 |
| 22107 | huICOS | 530.3 | 1.06E+03 | 5.60E-04 |
| 22108 | huICOS | 192 | 5.94E+03 | 1.14E-03 |

Figure 22C

| XENP | Antigen | $K_D$ (nM) | $k_a$ (1/Ms) | $k_d$ (1/s) |
|---|---|---|---|---|
| 22050 | huICOS | <0.001 | 3.34E+04 | <1.0E-07 |
| 22052 | huICOS | <0.001 | 4.37E+04 | <1.0E-07 |
| 22053 | huICOS | 13 | 6.83E+04 | 8.86E-04 |
| 22054 | huICOS | very weak | very weak | very weak |
| 22057 | huICOS | 0.00722 | 1.06E+05 | 7.65E-07 |
| 22064 | huICOS | <0.001 | 4.79E+04 | <1.0E-07 |
| 22065 | huICOS | <0.001 | 3.41E+04 | <1.0E-07 |
| 22069 | huICOS | <0.001 | 4.57E+03 | <1.0E-07 |
| 22073 | huICOS | very weak | very weak | very weak |
| 22074 | huICOS | 1.31 | 7.57E+04 | 9.88E-05 |
| 22077 | huICOS | very weak | very weak | very weak |
| 22084 | huICOS | <0.001 | 1.19E+04 | <1.0E-07 |
| 22089 | huICOS | 3.12 | 5.78E+04 | 1.80E-04 |
| 22091 | huICOS | 142 | 1.50E+04 | 2.13E-03 |
| 22093 | huICOS | 399 | 7.82E+02 | 3.12E-04 |
| 22094 | huICOS | 14.2 | 7.46E+04 | 1.06E-03 |
| 22095 | huICOS | 11 | 6.60E+04 | 7.25E-04 |
| 22102 | huICOS | 0.886 | 9.10E+04 | 8.07E-05 |
| 22103 | huICOS | 1.5 | 7.23E+04 | 1.09E-04 |
| 22104 | huICOS | 1.33 | 3.66E+04 | 4.86E-05 |
| 22106 | huICOS | 2060 | 4.81E+02 | 9.93E-04 |
| 22108 | huICOS | 17.5 | 7.61E+04 | 1.33E-03 |

Figure 23

| XENP | Antigen | $K_D$ (nM) | $k_a$ (1/Ms) | $k_d$ (1/s) |
|---|---|---|---|---|
| 22050 | huICOS | 1.936 | 7.65E+04 | 1.48E-04 |
| 22091 | huICOS | 54.56 | 3.00E+04 | 1.64E-03 |
| 22780 | huICOS | 3.131 | 6.41E+04 | 2.01E-04 |
| 22781 | huICOS | 14.64 | 1.03E+05 | 1.50E-03 |
| 22782 | huICOS | 7.457 | 5.62E+04 | 4.19E-04 |
| 22783 | huICOS | 39.55 | 3.49E+04 | 1.38E-03 |
| 22784 | huICOS | 27.81 | 9.13E+04 | 2.54E-03 |
| 22861 | huICOS | 5206 | 1.36E+03 | 7.07E-03 |
| 22862 | huICOS | 239.4 | 2.51E+04 | 6.00E-03 |
| 22863 | huICOS | 102.3 | 3.49E+04 | 3.57E-03 |
| 22929 | huICOS | 12.39 | 4.56E+04 | 5.65E-04 |
| 22938 | huICOS | 43.94 | 3.89E+04 | 1.71E-03 |
| 22939 | huICOS | 24.49 | 5.84E+04 | 1.43E-03 |
| 22940 | huICOS | 18.9 | 7.10E+04 | 1.34E-03 |
| 22941 | huICOS | 81.29 | 3.80E+04 | 3.09E-03 |
| 22944 | huICOS | 4.415 | 6.29E+04 | 2.78E-04 |
| 22945 | huICOS | 40.62 | 5.31E+04 | 2.16E-03 |
| 22946 | huICOS | 19.38 | 6.71E+04 | 1.30E-03 |

Figure 24A

XENP024352 [anti-ICOS]_H0L0_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS | 29582 |
| vhCDR1 | GYYMH | 29583 |
| vhCDR2 | WINPHSGGTNYAQKFQG | 29584 |
| vhCDR3 | TYYYDSSGYYHDAFDI | 29585 |
| scFv linker | GKPGSGKPGSGKPGSGKPGS | 29586 |
| Variable light (vl) domain | DIQMTQSPSSVSASVGDRVTITCRASQGISRLLAWYQQKPGKAPKLLIYVASSLQSGVPSRFSGSGSGTDFTLTISSLQPEDFATYYCQQA NSFPWTFGQGTKVEIK | 29587 |
| vlCDR1 | RASQGISRLLA | 29588 |
| vlCDR2 | VASSLQS | 29589 |
| vlCDR3 | QQANSFPWT | 29590 |
| scFv | QVQLVQSGAEVKKPGASVKVSCKASGYTFTGYYMHWVRQAPGQGLEWMGWINPHSGGTNYAQKFQGRVTMTRDTSISTAYMELS RLRSDDTAVYYCARTYYYDSSGYYHDAFDIWGQGTMVTVSS/GKPGSGKPGSGKPGSGKPGS/DIQMTQSPSSVSASVGDRVTITCRA SQGISRLLAWYQQKPGKAPKLLIYVASSLQSGVPSRFSGSGSGTDFTLTISSLQPEDFATYYCQQANSFPWTFGQGTKVEIK/GS | 29591 |

Figure 24B

XENP024353 [anti-ICOS]_L0H0_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSS | 29592 |
| vhCDR1 | GYYMH | 29593 |
| vhCDR2 | WINPHSGGTNYAQKFQG | 29594 |
| vhCDR3 | TYYYDSSGYYHDAFDI | 29595 |
| scFv linker | GKPGSGKPGSGKPGSGKPGS | 29596 |
| Variable light (vl) domain | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK | 29597 |
| vlCDR1 | RASQGISRLLA | 29598 |
| vlCDR2 | VASSLQS | 29599 |
| vlCDR3 | QQANSFPWT | 29600 |
| scFv | DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSS/GS | 29601 |

Figure 24C

XENP024354 [anti-ICOS]_H0.40_L0.22_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELS SLRSEDTAVYYCARTYYYDTSGYYHDAFDVWGQGTMVTVSS | 29602 |
| vhCDR1 | GYYMH | 29603 |
| vhCDR2 | WINPHSGETNYAQKFQG | 29604 |
| vhCDR3 | TYYYDTSGYYHDAFDV | 29605 |
| scFv linker | GKPGSGKPGSGKPGSGKPGS | 29606 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYCQQA NSFPWTFGQGTKVEIK | 29607 |
| vlCDR1 | RASQDISRLLA | 29608 |
| vlCDR2 | AASSLQS | 29609 |
| vlCDR3 | QQANSFPWT | 29610 |
| scFv | QVQLVQSGAEVKKPGASVKVSCKASGYTFTGYYMHWVRQAPGQGLEWMGWINPHSGETNYAQKFQGRVTMTRDTSISTAYMELS SLRSEDTAVYYCARTYYYDTSGYYHDAFDVWGQGTMVTVSS/GKPGSGKPGSGKPGSGKPGS/DIQMTQSPSSVSASVGDRVTITCRA SQDISRLLAWYQQKPGKAPKLLIYAASSLQSGVPSRFSGSGSGTDFTLTISSLQPEDFATYCQQANSFPWTFGQGTKVEIK/GS | 29611 |

Figure 24D

XENP024355 [anti-ICOS]_H0.40_L0.45_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELS SLRSEDTAVYYCARTYYYDTSGYYHDAFDVWGQGTMVTVSS | 29612 |
| vhCDR1 | GYYMH | 29613 |
| vhCDR2 | WINPHSGETNYAQKFQG | 29614 |
| vhCDR3 | TYYYDTSGYYHDAFDV | 29615 |
| scFv linker | GKPGSGKPGSGKPGSGKPGS | 29616 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQA QSFPWTFGQGTKVEIK | 29617 |
| vlCDR1 | RASQDISRLLA | 29618 |
| vlCDR2 | AASSLQS | 29619 |
| vlCDR3 | QQAQSFPWT | 29620 |
| scFv | QVQLVQSGAEVKKPGASVKVSCKASGYTFTGYYMHWVRQAPGQGLEWMGWINPHSGETNYAQKFQGRVTMTRDTSISTAYMELS SLRSEDTAVYYCARTYYYDTSGYYHDAFDVWGQGTMVTVSS/GKPGSGKPGSGKPGSGKPGS/DIQMTQSPSSVSASVGDRVTITCRA SQDISRLLAWYQQKPGKAPKLLIYAASSLQSGVPSRFSGSGSGTDFTLTISSLQPEDFATYYCQQAQSFPWTFGQGTKVEIK/GS | 29621 |

Figure 24E

XENP024356 [anti-ICOS]_H0.66_L0.22_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS | 29622 |
| vhCDR1 | GYYMH | 29623 |
| vhCDR2 | WINPHSGETIYAQKFQG | 29624 |
| vhCDR3 | TYYYDTSGYYHDAFDV | 29625 |
| scFv linker | GKPGSGKPGSGKPGSGKPGS | 29626 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK | 29627 |
| vlCDR1 | RASQDISRLLA | 29628 |
| vlCDR2 | AASSLQS | 29629 |
| vlCDR3 | QQANSFPWT | 29630 |
| scFv | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS/GKPGSGKPGSGKPGSGKPGS/DIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK/GS | 29631 |

Figure 24F

XENP024357 [anti-ICOS]_H0.66_L0.45_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS | 29632 |
| vhCDR1 | GYYMH | 29633 |
| vhCDR2 | WINPHSGETIYAQKFQG | 29634 |
| vhCDR3 | TYYYDTSGYYHDAFDV | 29635 |
| scFv linker | GKPGSGKPGSGKPGSGKPGS | 29636 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK | 29637 |
| vlCDR1 | RASQDISRLLA | 29638 |
| vlCDR2 | AASSLQS | 29639 |
| vlCDR3 | QQAQSFPWT | 29640 |
| scFv | QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS/GKPGSGKPGSGKPGSGKPGS/DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK/GS | 29641 |

Figure 24G

XENP024609 [anti-ICOS]_L0.45_H0.40_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELS SLRSEDTAVYYCARTYYYDTSGYYHDAFDVWGQGTMVTVSS | 29642 |
| vhCDR1 | GYYMH | 29643 |
| vhCDR2 | WINPHSGETNYAQKFQG | 29644 |
| vhCDR3 | TYYYDTSGYYHDAFDV | 29645 |
| scFv linker | GKPGSGKPGSGKPGSGKPGS | 29646 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQA QSFPWTFGQGTKVEIK | 29647 |
| vlCDR1 | RASQDISRLLA | 29648 |
| vlCDR2 | AASSLQS | 29649 |
| vlCDR3 | QQAQSFPWT | 29650 |
| scFv | DIQMTQSPSSVSASVGDRVTITCRASQDISRLLAWYQQKPGKAPKLLIYAASSLQSGVPSRFSGSGSGTDFTLTISSLQPEDFATYYCQQA QSFPWTFGQGTKVEIK/GKPGSGKPGSGKPGSGKPGS/QVQLVQSGAEVKKPGASVKVSCKASGYTFTGYYMHWVRQAPGQGLEW MGWINPHSGETNYAQKFQGRVTMTRDTSISTAYMELSSLRSEDTAVYYCARTYYYDTSGYYHDAFDVWGQGTMVTVSS/GS | 29651 |

Figure 24H

XENP024689 [anti-ICOS]_L0.45_H0.37_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSS | 29652 |
| vhCDR1 | GYYMH | 29653 |
| vhCDR2 | WINPHSGGTNYAQKFQG | 29654 |
| vhCDR3 | TYYYDTSGYYHDAFDV | 29655 |
| scFv linker | GKPGSGKPGSGKPGSGKPGS | 29656 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK | 29657 |
| vlCDR1 | RASQDISRLLA | 29658 |
| vlCDR2 | AASSLQS | 29659 |
| vlCDR3 | QQAQSFPWT | 29660 |
| scFv | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSS/GS | 29661 |

Figure 241

XENP024690 [anti-ICOS]_L0.45_H0.68_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSS | 29662 |
| vhCDR1 | GYYMH | 29663 |
| vhCDR2 | WINPHSGETNYAQKFQG | 29664 |
| vhCDR3 | TYYYDTSGYYHDAFDV | 29665 |
| scFv linker | GKPGSGKPGSGKPGSGKPGS | 29666 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK | 29667 |
| vlCDR1 | RASQDISRLLA | 29668 |
| vlCDR2 | AASSLQS | 29669 |
| vlCDR3 | QQAQSFPWT | 29670 |
| scFv | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSS/GS | 29671 |

Figure 24J

XENP024691 [anti-ICOS]_L0.45_H0.35_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSS | 29672 |
| vhCDR1 | GYYMH | 29673 |
| vhCDR2 | WINPHSGGTNYAQKFQG | 29674 |
| vhCDR3 | TYYYDTSGYYHDAFDV | 29675 |
| scFv linker | GKPGSGKPGSGKPGSGKPGS | 29676 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK | 29677 |
| vlCDR1 | RASQDISRLLA | 29678 |
| vlCDR2 | AASSLQS | 29679 |
| vlCDR3 | QQAQSFPWT | 29680 |
| scFv | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSS/GS | 29681 |

Figure 24K

XENP024692 [anti-ICOS]_L0.45_H0.34_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSS | 29682 |
| vhCDR1 | GYYMH | 29683 |
| vhCDR2 | WINPHSGGTNYAQKFQG | 29684 |
| vhCDR3 | TYYYDSSGYYHDAFDV | 29685 |
| scFv linker | GKPGSGKPGSGKPGSGKPGS | 29686 |
| Variable light (vl) domain | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK | 29687 |
| vlCDR1 | RASQDISRLLA | 29688 |
| vlCDR2 | AASSLQS | 29689 |
| vlCDR3 | QQAQSFPWT | 29690 |
| scFv | DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSS/GS | 29691 |

Figure 24L

XENP024693 [anti-ICOS]_L0.46_H0.40_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS | 29692 |
| vhCDR1 | GYYMH | 29693 |
| vhCDR2 | WINPHSGETNYAQKFQG | 29694 |
| vhCDR3 | TYYYDTSGYYHDAFDV | 29695 |
| scFv linker | GKPGSGKPGSGKPGSGKPGS | 29696 |
| Variable light (vl) domain | DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIK | 29697 |
| vlCDR1 | RASQSISRLLA | 29698 |
| vlCDR2 | AASSLQS | 29699 |
| vlCDR3 | QQAQSFPWT | 29700 |
| scFv | DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS/GS | 29701 |

Figure 24M

XENP024694 [anti-ICOS]_L0.47_H0.40_scFv

| What | sequence | SEQ ID NO: |
|---|---|---|
| Variable heavy (vh) domain | QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS | 29702 |
| vhCDR1 | GYYMH | 29703 |
| vhCDR2 | WINPHSGETNYAQKFQG | 29704 |
| vhCDR3 | TYYYDTSGYYHDAFDV | 29705 |
| scFv linker | GKPGSGKPGSGKPGSGKPGS | 29706 |
| Variable light (vl) domain | DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIK | 29707 |
| vlCDR1 | RASQDISRLLA | 29708 |
| vlCDR2 | SASSLQS | 29709 |
| vlCDR3 | QQAQSFPWT | 29710 |
| scFv | DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIK/GKPGSGKPGSGKPGSGKPGS/QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS/GS | 29711 |

Figure 25

| XENP | $T_m$ (°C) | $\Delta T_m$ (°C) |
|---|---|---|
| 24352 | 56 | 0 |
| 24354 | 65.5 | 9.5 |
| 24353 | 59 | 3 |
| 24355 | 67 | 11 |
| 24356 | 64.5 | 8.5 |
| 24357 | 66 | 10 |
| 24609 | 69 | 13 |
| 24689 | 66.5 | 10.5 |
| 24690 | 69 | 13 |
| 24691 | 66.5 | 10.5 |
| 24692 | 67 | 11 |
| 24693 | 67.5 | 11.5 |
| 24694 | 68.5 | 12.5 |

Figure 26A

XENP22730

>XENP022730 [ICOS]_H0L0_Fab-1G6_L1.194_H1.279 Fab-Fc Heavy Chain (SEQ ID NO: 29712)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSG
YHDAFDIWGQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDT
KVDKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVLHEAL
HSHYTQKSLSLSPGK >XENP022730 [ICOS]_H0L0_Fab-1G6_L1.194_H1.279 scFv-Fc Heavy Chain (SEQ ID NO: 29713)
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPG
SGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTED
TGVYYCTRYYGNYGGYFDVWGRGTLVTVSS/EPKSSDKTHTCPPCPAPPVAGPSVFLFPPKPKDTLMISRTPEVTCVVVDVKHEDPEVKFNWYVDGVEHNAKTKPREEQ
YNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVLHEALHSHYTQKSLSLSPGK >XENP022730 [ICOS]_H0L0_Fab-1G6_L1.194_H1.279 Light Chain (SEQ ID NO: 29714)
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/RTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 26B

XENP23377

>XENP023377_11D4[OX40]_H0L0_Fab-1G6_L1.194_H1.279_scFv Fab-Fc Heavy Chain (SEQ ID NO: 29715)
EVQLVESGGGLVQPGGSLRLSCAASGFTFSSYSMNWVRQAPGKGLEWVSYISSSSTIDYADSVKGRFTISRDNAKNSLYLQMNSLRDEDTAVYYCARESGWVLFDYWGQ
GTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESDGQPENNYKTTPPVLDSDGSFFLYSKLTVDKSRWQEGDVFSCSVMHEALHNHYTQKSLSLSP
GK >XENP023377_11D4[OX40]_H0L0_Fab-1G6_L1.194_H1.279_scFv scFv-Fc Heavy Chain (SEQ ID NO: 29716)
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPG
SGKPGSGKPGSGKPGS/EVQLVESGGGLVKPGGSLRLSCVASGFTFSNYWMNWVRQAPGKGLEWVAEIRLYSNINYATHYAESVKGRFTISRDDSKSTLYLQMNNLKTED
TGVYYCTRYYGNYGGYFDVWGRGTLVTVSS/EPKSSDKTHTCPPCPAPPVAGPSVFLFPPKPKDTLMISRTPEVTCVVVDVKHEDPEVKFNWYVDGVEVHNAKTPREEQ
YNSTYRVVSVLTVLHQDWLNGKEYKCKVSNKALPAPIEKTISKAKGQPREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK >XENP023377_11D4[OX40]_H0L0_Fab-1G6_L1.194_H1.279_scFv Light Chain (SEQ ID NO: 29717)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK/RTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 26C

XENP23378

>XENP023378 1D8[GITR]_H0L0_Fab-1G6_L1.194_H1.279_scFv Fab-Fc Heavy Chain (SEQ ID NO: 29718)
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYW
GQGTSVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESDGQPENNYKTTPPVLDSDGSFFLYSKLTVDKSRWQEGNVFSCSVMHEALHNHYTQKSL
SLSPGK >XENP023378 1D8[GITR]_H0L0_Fab-1G6_L1.194_H1.279_scFv scFv-Fc Heavy Chain (SEQ ID NO: 29719)
EIVLTQSPATLSASPGERVTLTCRASQSVGNDVAWYQQKPGQAPRLLINVASHRYTGVPDRFTGSGYGTEFTLTISSVQSEDFGVYYCQQDFSSPRTFGGGTKVEIK/GKPG
SGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTED
TGVYYCTRYYGNYGGYFDVWGRGTLVTVSS/EPKSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK >XENP023378 1D8[GITR]_H0L0_Fab-1G6_L1.194_H1.279_scFv Light Chain (SEQ ID NO: 29720)
DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQTHVPPTFGGGTKLEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 26D

XENP23379

>XENP023379_20H4.9[4-1BB]_H0L0_Fab-1G6_L1.194_H1.279_scFv Fab-Fc Heavy Chain (SEQ ID NO: 29721)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDL
WGRGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCDVSGFYPSDIAVEWESNGQPENNYKTTPPVLDSDGSFFLYSKLTVDKSRWQEGDVFSCSVMHEALHNHYTQKS
LSLSPGK >XENP023379_20H4.9[4-1BB]_H0L0_Fab-1G6_L1.194_H1.279_scFv scFv-Fc Heavy Chain (SEQ ID NO: 29722)
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPG
SGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTED
TGVYYCTRYYGNYGGYFDVWGRGTLVTVSS/EPKSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK >XENP023379_20H4.9[4-1BB]_H0L0_Fab-1G6_L1.194_H1.279_scFv Light Chain (SEQ ID NO: 29723)
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIK/RTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 32A

XENP20896

>XENP020896 [ICOS]_H0L0_Fab-1G6_L1.194_H1.279 Fab-Fc Heavy Chain (SEQ ID NO: 29724)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP020896 [ICOS]_H0L0_Fab-1G6_L1.194_H1.279 scFv-Fc Heavy Chain (SEQ ID NO: 29725)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP020896 [ICOS]_H0L0_Fab-1G6_L1.194_H1.279 Light Chain (SEQ ID NO: 29726)

DIQMTQSPSSVSASVGDRVTITCRASQGISRLLAWYQQKPGKAPKLLIYVASSLQSGVPSRFSGSGSGTDFTLTISSLQPED
FATYYCQQANSFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

XENP22433

>XENP022433 [ICOS]_H0_L0.7_Fab-1G6_L1.194_H1.279 Fab-Fc Heavy Chain (SEQ ID NO: 29727)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP022433 [ICOS]_H0_L0.7_Fab-1G6_L1.194_H1.279 scFv-Fc Heavy Chain (SEQ ID NO: 29728)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP022433 [ICOS]_H0_L0.7_Fab-1G6_L1.194_H1.279 Light Chain (SEQ ID NO: 29729)

DIQMTQSPSSVSASVGDRVTITCRASQGISSYLAWYQQKPGKAPKLLIYVASSLQSGVPSRFSGSGSGTDFTLTISSLQPED
FATYYCQQANSFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

Figure 32B

XENP22744

>XENP022744 [ICOS]_H0_L0.34_Fab-1G6_L1.194_H1.279 Fab-Fc Heavy Chain (SEQ ID NO: 29730)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP022744 [ICOS]_H0_L0.34_Fab-1G6_L1.194_H1.279 scFv-Fc Heavy Chain (SEQ ID NO: 29731)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP022744 [ICOS]_H0_L0.34_Fab-1G6_L1.194_H1.279 Light Chain (SEQ ID NO: 29732)

DIQMTQSPSSVSASVGDRVTITCQASQDISRLLAWYQQKPGKAPKLLIYVASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

XENP22746

>XENP022746 [ICOS]_H0_L0.36_Fab-1G6_L1.194_H1.279 Fab-Fc Heavy Chain (SEQ ID NO: 29733)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP022746 [ICOS]_H0_L0.36_Fab-1G6_L1.194_H1.279 scFv-Fc Heavy Chain (SEQ ID NO: 29734)

EIVLTQSPATLSASPGERVTLTCKASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP022746 [ICOS]_H0_L0.36_Fab-1G6_L1.194_H1.279 Light Chain (SEQ ID NO: 29735)

DIQMTQSPSSVSASVGDRVTITCQASQDISSLLAWYQQKPGKAPKLLIYVASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

Figure 32C

XENP22747

>XENP022747 [ICOS]_H0_L0.37_Fab-1G6_L1.194_H1.279 Fab-Fc Heavy Chain (SEQ ID NO: 29736)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP022747 [ICOS]_H0_L0.37_Fab-1G6_L1.194_H1.279 scFv-Fc Heavy Chain (SEQ ID NO: 29737)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP022747 [ICOS]_H0_L0.37_Fab-1G6_L1.194_H1.279 Light Chain (SEQ ID NO: 29738)

DIQMTQSPSSVSASVGDRVTITCQASQDISRLLAWYQQKPGKAPKLLIYAASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

XENP22748

>XENP022748 [ICOS]_H0_L0.38_Fab-1G6_L1.194_H1.279 Fab-Fc Heavy Chain (SEQ ID NO: 29739)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP022748 [ICOS]_H0_L0.38_Fab-1G6_L1.194_H1.279 scFv-Fc Heavy Chain (SEQ ID NO: 29740)

EIVLTQSPATLSASPGERVTLTCKASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP022748 [ICOS]_H0_L0.38_Fab-1G6_L1.194_H1.279 Light Chain (SEQ ID NO: 29741)

DIQMTQSPSSVSASVGDRVTITCQASQDISSLLAWYQQKPGKAPKLLIYAASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

Figure 32D

XENP23092

>XENP023092 [ICOS]_H0.66_L0_Fab-1G6_L1.194_H1.279 Fab-Fc Heavy Chain (SEQ ID NO: 29742)

QVQLVQSGAEVKKPGASVKVSCKASGYTFTGYYMHWVRQAPGQGLEWMGWINPHSGETIYAQKFQGRVTMTRDTSISTAYME
LSSLRSEDTAVYYCARTYYYDTSGYYHDAFDVWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP023092 [ICOS]_H0.66_L0_Fab-1G6_L1.194_H1.279 scFv-Fc Heavy Chain (SEQ ID NO: 29743)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP023092 [ICOS]_H0.66_L0_Fab-1G6_L1.194_H1.279 Light Chain (SEQ ID NO: 29744)

DIQMTQSPSSVSASVGDRVTITCRASQGISRLLAWYQQKPGKAPKLLIYVASSLQSGVPSRFSGSGSGTDFTLTISSLQPED
FATYYCQQANSFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

XENP23410

>XENP023410 [ICOS]_H0.66_L0.34_Fab-1G6_L1.194_H1.279 Fab-Fc Heavy Chain (SEQ ID NO: 29745)

QVQLVQSGAEVKKPGASVKVSCKASGYTFTGYYMHWVRQAPGQGLEWMGWINPHSGETIYAQKFQGRVTMTRDTSISTAYME
LSSLRSEDTAVYYCARTYYYDTSGYYHDAFDVWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP023410 [ICOS]_H0.66_L0.34_Fab-1G6_L1.194_H1.279 scFv-Fc Heavy Chain (SEQ ID NO: 29746)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP023410 [ICOS]_H0.66_L0.34_Fab-1G6_L1.194_H1.279 Light Chain (SEQ ID NO: 29747)

DIQMTQSPSSVSASVGDRVTITCQASQDISRLLAWYQQKPGKAPKLLIYVASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

Figure 33A

XENP22730

>XENP022730 [ICOS]_H0L0_Fab-1G6_L1.194_H1.279 Fab-Fc Heavy Chain (SEQ ID NO: 29748)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYRDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

>XENP022730 [ICOS]_H0L0_Fab-1G6_L1.194_H1.279 scFv-Fc Heavy Chain (SEQ ID NO: 29749)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

>XENP022730 [ICOS]_H0L0_Fab-1G6_L1.194_H1.279 Light Chain (SEQ ID NO: 29750)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP22974

>XENP022974 [ICOS]_H0_L0.34_Fab-1G6_L1.194_H1.279 Fab-Fc Heavy Chain (SEQ ID NO: 29751)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYRDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

>XENP022974 [ICOS]_H0_L0.34_Fab-1G6_L1.194_H1.279 scFv-Fc Heavy Chain (SEQ ID NO: 29752)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Figure 33B

>XENP022974 [ICOS]_H0_L0.34_Fab-1G6_L1.194_H1.279 Light Chain (SEQ ID NO: 29753)

DIQMTQSPSSVSASVGDRVTITCQASQDISRLLAWYQQKPGKAPKLLIYVASSLQSGVPSRFSGSGSGTDFTLTISS
LQPEDFATYYCQQAESFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP23104

>XENP023104 [ICOS]_H0.66_L0_Fab-1G6_L1.194_H1.279 Fab-Fc Heavy Chain (SEQ ID NO: 29754)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

>XENP023104 [ICOS]_H0.66_L0_Fab-1G6_L1.194_H1.279 scFv-Fc Heavy Chain (SEQ ID NO: 29755)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

>XENP023104 [ICOS]_H0.66_L0_Fab-1G6_L1.194_H1.279 Light Chain (SEQ ID NO: 29756)

DIQMTQSPSSVSASVGDRVTITCRASQGISPLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP23411

>XENP023411 [ICOS]_H0.66_L0.34_Fab-1G6_L1.194_H1.279 Fab-Fc Heavy Chain (SEQ ID NO: 29757)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

Figure 33C

>XENP023411 [ICOS]_H0.66_L0.34_Fab-1G6_L1.194_H1.279 scFv-Fc Heavy Chain (SEQ ID NO: 29758)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

>XENP023411 [ICOS]_H0.66_L0.34_Fab-1G6_L1.194_H1.279 Light Chain (SEQ ID NO: 29759)

DIQMTQSPSSVSASVGDRVTITCQASQDISRLLAWYQQKPGKAPKLLIYVASSLQSGVPSRFSGSGSGTDFTLTISS
LQPEDFATYYCQQAESFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 34A

| XENP | Antigen | $K_D$ (nM) | $k_a$ (1/Ms) | $k_d$ (1/s) |
|---|---|---|---|---|
| 22438 | huICOS | 2.28 | 2.49E+05 | 5.69E-04 |
| 22437 | huICOS | 0.5613 | 2.05E+05 | 1.15E-04 |
| 22436 | huICOS | 1.813 | 2.49E+05 | 4.52E-04 |
| 22435 | huICOS | 1.411 | 2.27E+05 | 3.20E-04 |
| 22434 | huICOS | 2.766 | 2.33E+05 | 6.44E-04 |
| 22433 | huICOS | 3.8 | 1.88E+05 | 7.15E-04 |
| 22432 | huICOS | 0.6282 | 2.02E+05 | 1.27E-04 |
| 20896 | huICOS | 0.4358 | 2.20E+05 | 9.57E-05 |

Figure 34B

| XENP | Antigen | $K_D$ (nM) | $k_a$ (1/Ms) | $k_d$ (1/s) |
|---|---|---|---|---|
| 20896 | huICOS | <0.001 | 8.58E+04 | <1.0E-07 |
| 22432 | huICOS | 1.78 | 8.46E+04 | 1.50E-04 |
| 22433 | huICOS | 9.68 | 5.78E+04 | 5.59E-04 |
| 22434 | huICOS | 3.99 | 7.48E+04 | 2.99E-04 |
| 22435 | huICOS | 3.44 | 1.28E+05 | 4.40E-04 |
| 22436 | huICOS | 1.43 | 1.03E+05 | 1.47E-04 |
| 22437 | huICOS | 0.34 | 7.82E+04 | 2.66E-05 |
| 22438 | huICOS | 6.2 | 9.80E+04 | 6.07E-04 |

Figure 34C

| XENP | Antigen | $K_D$ (nM) | $k_a$ (1/Ms) | $k_d$ (1/s) |
|---|---|---|---|---|
| 20896 | huICOS | 1.58 | 6.55E+04 | 1.04E-04 |
| 22433 | huICOS | 11.6 | 6.19E+04 | 7.21E-04 |
| 22740 | huICOS | 11.5 | 7.56E+04 | 8.68E-04 |
| 22741 | huICOS | 13 | 8.00E+04 | 1.04E-03 |
| 22742 | huICOS | 2.08 | 8.49E+04 | 1.76E-04 |
| 22743 | huICOS | 4.41 | 9.21E+04 | 4.06E-04 |
| 22744 | huICOS | 2.15 | 6.07E+04 | 1.30E-04 |
| 22745 | huICOS | 9.12 | 7.87E+04 | 7.18E-04 |
| 22746 | huICOS | 4.52 | 5.97E+04 | 2.70E-04 |
| 22747 | huICOS | 10.1 | 5.56E+04 | 5.63E-04 |
| 22748 | huICOS | 11.9 | 6.64E+04 | 7.88E-04 |

Figure 35

| XENP | huICOS $K_D$ (nM) | huICOS $k_a$ (1/Ms) | huICOS $k_d$ (1/s) | cynoICOS $K_D$ (nM) | cynoICOS $k_a$ (1/Ms) | cynoICOS $k_d$ (1/s) |
|---|---|---|---|---|---|---|
| 20896 | 2.09 | 5.45E+04 | 1.14E-04 | 2.41 | 5.70E+04 | 1.38E-04 |
| 22433 | 41.30 | 2.64E+04 | 1.09E-03 | 35.30 | 3.10E+04 | 1.10E-03 |
| 22744 | 3.91 | 3.50E+04 | 1.37E-04 | 5.82 | 3.27E+04 | 1.90E-04 |
| 22745 | 17.60 | 6.01E+04 | 1.06E-03 | 14.50 | 7.84E+04 | 1.14E-03 |
| 22746 | 10.10 | 3.76E+04 | 3.81E-04 | 11.90 | 3.14E+04 | 3.73E-04 |
| 22747 | 18.40 | 5.05E+04 | 9.27E-04 | 21.50 | 4.53E+04 | 9.73E-04 |
| 22748 | 42.30 | 4.26E+04 | 1.80E-03 | 39.40 | 4.93E+04 | 1.94E-03 |
| 23090 | 2.73 | 5.60E+04 | 1.53E-04 | ND | ND | ND |
| 23091 | 5.62 | 4.75E+04 | 2.67E-04 | ND | ND | ND |
| 23092 | 4.30 | 5.80E+04 | 2.50E-04 | ND | ND | ND |
| 23093 | 5.43 | 5.70E+04 | 3.09E-04 | ND | ND | ND |
| 23410 | 9.04 | 3.56E+04 | 3.22E-04 | ND | ND | ND |

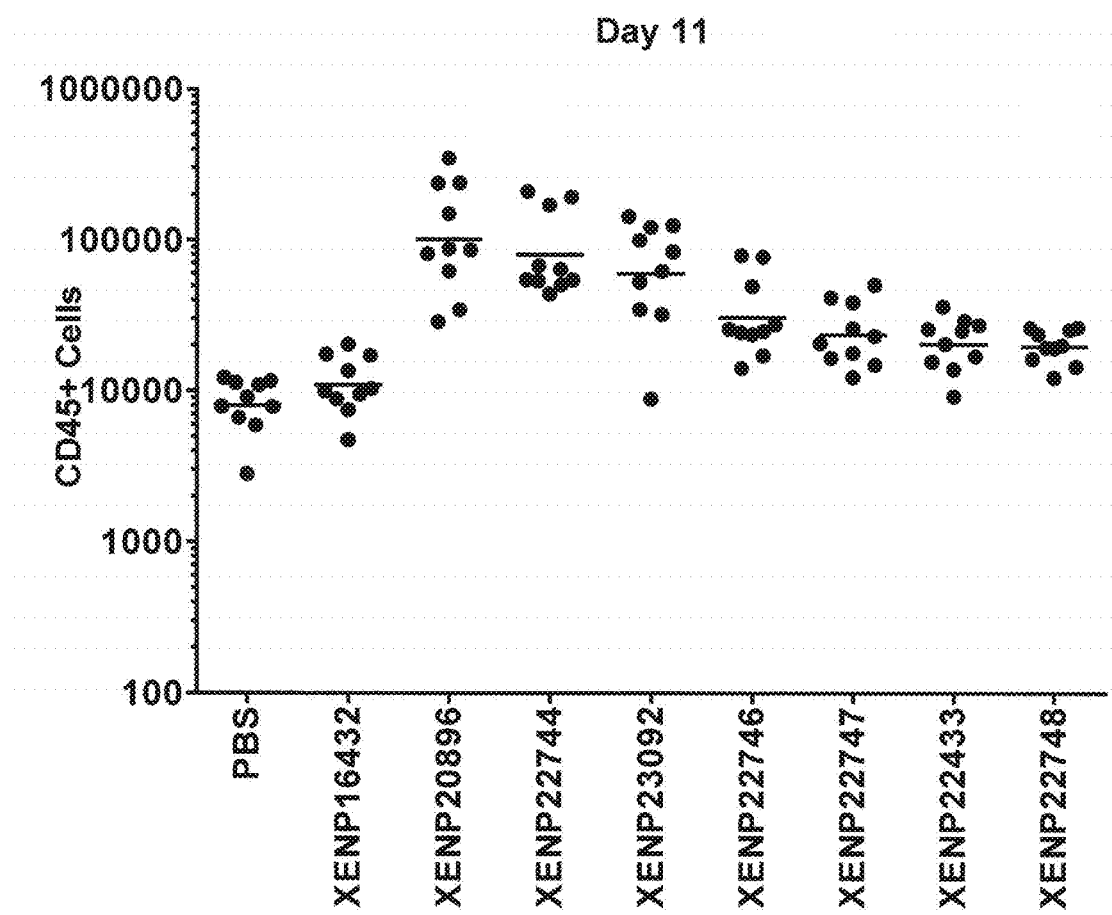

Figure 48A

XENP21828

>XENP021828 GSK_314.8[ICOS]_H0L0_Fab-1G6_L1.194_H1.279_scFv Fab-Fc Heavy Chain (SEQ ID NO: 29760)

QVQLQQPGTELMKPGASVKLSCKASGYTFTTYWMHWVKQRPGQGLEWIGEIDPSDSYVNYNQMFKGKATLTVDKSSSTAYIQ
LSSLTSEDSAVYFCARSDYYGTSLAWFDYWGQGTLVTVST/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

>XENP021828 GSK_314.8[ICOS]_H0L0_Fab-1G6_L1.194_H1.279_scFv scFv-Fc Heavy Chain (SEQ ID NO: 29761)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP021828 GSK_314.8[ICOS]_H0L0_Fab-1G6_L1.194_H1.279_scFv Light Chain (SEQ ID NO: 29762)

DIVMTQAAPSVPVTPGESVSISCRSSKSPLRSNGNIYLYWFLQRPGQSPQLLIYRMSNLASGVPDRFSGSGSGTTFTLKISR
VEAEDVGVYYCMQHLEYPYTFGGGTKLEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

XENP21829

>XENP021829 GSK_88.2[ICOS]_H0L0_Fab-1G6_L1.194_H1.279_scFv Fab-Fc Heavy Chain (SEQ ID NO: 29763)

QVQLQQPGAELVRPGASVKLSCKASGYSFTEYWINWVKQRPGQGLEWIGNIYPSDSYTNYNQMFKDKATLTVDKSSNTAYMQ
LTSPTSEDSAVYYCTRWNLSYYFDNNYYLDYWGQGTTLTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSDTKVDKKVEPKSCDKTHTCPPCPAPPVAGPS
VFLFPPKPKDTLMISRTPEVTCVVVDVKHEDPEVKFNWYVDGVEVHNAKTKPREEEYNSTYRVVSVLTVLHQDWLNGKEYKC
KVSNKALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK

>XENP021829 GSK_88.2[ICOS]_H0L0_Fab-1G6_L1.194_H1.279_scFv scFv-Fc Heavy Chain (SEQ ID NO: 29764)

EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Figure 48B

>XENP021829 GSK_88.2[ICOS]_H0L0_Fab-1G6_L1.194_H1.279_scFv Light Chain (SEQ ID NO: 29765)

DIVMTQAAPSVPVTPGESVSISCRSSKSLLHSNGNTYLYWFLQRPGQSPQLLIYRMSNLASGVPDRFSGSGSGTAFT
LRISRVEAEDVGVYYCMQHLEYPWTFGGGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

XENP21830

>XENP021830 jMab-138[ICOS]_H0L0_Fab-1G6_L1.194_H1.279_scFv Fab-Fc Heavy Chain (SEQ ID NO: 29766)

EVQLVESGGGLVQPGGSLRLSCAASGFTFSSYDMHWVRQATGKGLEWVSAIGTAGDTYYPGSVKGRFTISRENAKNS
LYLQMNSLRAGDTAVYYCVRDNRKVTHEHYYYGMDVWGQGTTVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP021830 jMab-138[ICOS]_H0L0_Fab-1G6_L1.194_H1.279_scFv scFv-Fc Heavy Chain (SEQ ID NO: 29767)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

>XENP021830 jMab-138[ICOS]_H0L0_Fab-1G6_L1.194_H1.279_scFv Light Chain (SEQ ID NO: 29768)

EIVLTQSPGTLSLSPGERATLSCRASQNIRSSYLAWYQQKPGQAPGLLIYGASSRATGIPDRFSGSGSGTDFTLTIS
RLEPEDFAVYYCQQFGSSPMCSFGQGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

XENP21831

>XENP021831 jMab-139[ICOS]_H0L0_Fab-1G6_L1.194_H1.279_scFv Fab-Fc Heavy Chain (SEQ ID NO: 29769)

EVQLVESGGGLVQPGGSLRLSCAASGFTFSSYDMHWVRQATGKGLEWVSAIGTAGDTYYPGSVKGRFTISRENAKNS
LYLQMNSLRAGDTAVYYCVRDKRTVTHEHYYYGMDVWGQGTTVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

Figure 48C

>XENP021831 jMab-139[ICOS]_H0L0_Fab-1G6_L1.194_H1.279_scFv scFv-Fc Heavy Chain (SEQ ID NO: 29770)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

>XENP021831 jMab-139[ICOS]_H0L0_Fab-1G6_L1.194_H1.279_scFv Light Chain (SEQ ID NO: 29771)

EIVLTQSPGTLSLSPGERATLSCRASQSISSSSLAWYQQKPGQAPGLLIFGASSRATGIPDRFSGSGSGTDFTLTIS
RLEPEDFAVYYCQQFGSSPMCSFGQGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

XENP22348

>XENP022348 WO2016059602_GSK_H0L0_Fab-1G6_L1.194_H1.279_scFv Fab-Fc Heavy Chain (SEQ ID NO: 29772)

QVQLVQSGAEVKKPGSSVKVSCKASGYTFTDYAMHWVRQAPGQGLEWMGLISIYSDHTNYNQKFQGRVTITADKSTS
TAYMELSSLRSEDTAVYYCGRMNYGNYGWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

>XENP022348 WO2016059602_GSK_H0L0_Fab-1G6_L1.194_H1.279_scFv scFv-Fc Heavy Chain (SEQ ID NO: 29773)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

>XENP022348 WO2016059602_GSK_H0L0_Fab-1G6_L1.194_H1.279_scFv Light Chain (SEQ ID NO: 29774)

EIVLTQSPATLSLSPGERATLSCSASSSVSYMHWYQQKPGQAPRLLIYDTSKLASGIPARFSGSGSGTDYTLTISSL
EPEDFAVYYCFQGSGYPYTFGQGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 48D

XENP23059

>XENP023059 Jounce_37A10S713[ICOS]_H0L0_Fab-1G6_[PD-1]_L1.194_H1.279_scFv Fab-Fc Heavy Chain (SEQ ID NO: 29775)

EVQLVESGGGLVQPGGSLRLSCAASGFTFSDYWMDWVRQAPGKGLVWVSNIDEDGSITEYSPFVKGRFTISRDNAKN
TLYLQMNSLRAEDTAVYYCTRWGRFGFDSWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>XENP023059 Jounce_37A10S713[ICOS]_H0L0_Fab-1G6_[PD-1]_L1.194_H1.279_scFv scFv-Fc Heavy Chain (SEQ ID NO: 29776)

EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

>XENP023059 Jounce_37A10S713[ICOS]_H0L0_Fab-1G6_[PD-1]_L1.194_H1.279_scFv Light Chain (SEQ ID NO: 29777)

DIVMTQSPDSLAVSLGERATINCKSSQSLLSGSFNYLTWYQQKPGQPPKLLIFYASTRHTGVPDRFSGSGSGTDFTL
TISSLQAEDVAVYYCHHHYNAPPTFGPGTKVDIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 52

| | | XENP23104 | XENP16435 | XENP19686 | XENP16435 + XENP19686 |
|---|---|---|---|---|---|
| Th17 | IL17A | 14.6 | 7.8 | 2.0 | 5.9 |
| | IL17F | 5.4 | 3.3 | 1.8 | 3.9 |
| | IL22 | 3.6 | 2.5 | 1.3 | 2.7 |
| | IL21 | 2.0 | 1.4 | 1.0 | 1.5 |
| | CCL20 | 2.5 | 1.7 | 1.4 | 1.7 |
| | IL1R1 | 1.1 | 1.2 | 1.1 | 1.4 |
| | IL23R | 1.2 | 1.2 | 1.1 | 1.1 |
| | STAT3 | 1.0 | 0.9 | 1.1 | 0.9 |
| | RORC | 1.3 | 1.4 | 1.2 | 1.2 |
| | CCR6 | 0.8 | 1.0 | 1.0 | 1.0 |
| Th1 | IFNG | 13.1 | 3.5 | 1.8 | 5.7 |
| | TNF | 1.8 | 1.6 | 1.0 | 1.6 |
| | IL12A | 0.8 | 0.8 | 1.1 | 0.9 |
| | IL12B | 2.3 | 1.4 | 1.3 | 1.4 |
| | TBX21 | 1.6 | 1.3 | 1.1 | 1.4 |
| | STAT1 | 0.9 | 1.0 | 1.1 | 1.0 |
| | STAT4 | 0.9 | 0.9 | 1.0 | 0.8 |
| | IRF1 | 1.0 | 0.9 | 1.0 | 1.0 |
| | CXCR3 | 0.9 | 1.0 | 1.0 | 0.9 |
| | CCR5 | 0.8 | 0.8 | 1.0 | 0.7 |
| Th2 | IL4 | 1.2 | 1.1 | 1.2 | 1.2 |
| | IL5 | 4.3 | 3.6 | 1.8 | 3.2 |
| | IL9 | 10.3 | 3.1 | 2.5 | 5.1 |
| | IL13 | 2.4 | 1.9 | 1.4 | 1.8 |
| | IL24 | 1.7 | 1.3 | 1.3 | 2.0 |
| | TNFSF4 | 1.0 | 1.1 | 0.8 | 0.9 |
| | GATA3 | 1.3 | 1.1 | 1.2 | 1.1 |
| | STAT6 | 0.9 | 1.0 | 1.0 | 0.9 |
| | CCR2 | 0.8 | 0.9 | 1.0 | 0.9 |
| | CCR3 | 1.0 | 0.8 | 0.8 | 0.9 |
| Treg | TGFB1 | 1.1 | 1.1 | 1.0 | 1.0 |
| | SMAD3 | 0.7 | 0.8 | 0.9 | 0.8 |
| | ITGAE | 0.9 | 0.8 | 1.0 | 0.8 |
| | FOXP3 | 1.1 | 1.0 | 1.4 | 1.3 |

Figure 55A

Central scFv

Fab-Fc Heavy Chain (SEQ ID NO: 29778)

VH1/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLT
VDKSRWQQGDVFSCSVMHEALHNHYTQKSLSLSPGK

Fab-scFv-Fc Heavy Chain (SEQ ID NOS 29779-29780)

VH1/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCCKPGSGKPGS/VH2-scFv linker-
VL2/GGGGSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPENNYKTTPPVLDSDGSFFL
YSKLTVDKSRWQQGNVFSCSVMHEALHNHYTQKSLSLSPGK

Light Chain (SEQ ID NO: 29781)

VL1/RTVAAPSVFIFPPSDEQLKSGTASVVCLLNNFYPREAKVQWKVDNALQSGNSQESVTEQDSKDSTYSLSSTLTLSKADYEKHKVYACEVTHQGLS
SPVTKSFNRGEC

Central scFv2

Heavy Chain (SEQ ID NOS 29782-29783)

VH1/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCGGGSGGGGSGGGGS/VH2-scFv linker-
VL2/GGGGSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK

Figure 55B

Light Chain (SEQ ID NO: 29784)

VL1 / RTVAAPSVFIFPPSDEQLKSGTASVVCLLNNFYPREAKVQWKVDNALQSGNSQESVTEQDSKDSTYSLSSTLTLSKADYEKHKVYACEVTHQGLS
SPVTKSFNRGEC

Bispecific mAb

Heavy Chain 1 (SEQ ID NO: 29785)

VH1 / ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPPVAGPSVFLFPPKPKDTLMISRTPEVTCVVVDVKHEDPEVKFNWYVDGVEVHNAKTKPREEYNSTYRVVSVLTVLHQD
WLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLT
VDKSRWEQGDVFSCSVMHEALHNHYTQKSLSLSPGK

Heavy Chain 2 (SEQ ID NO: 29786)

VH2 / ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVD
KKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

Light Chain 1 (SEQ ID NO: 29787)

VL1 / RTVAAPSVFIFPPSDEQLKSGTASVVCLLNNFYPREAKVQWKVDNALQSGNSQESVTEQDSKDSTYSLSSTLTLSKADYEKHKVYACEVTHQGLS
SPVTKSFNRGEC

Light Chain 2 (SEQ ID NO: 29788)

VL2 / RTVAAPSVFIFPPSDEQLKSGTASVVCLLNNFYPREAKVQWKVDNALQSGNSQESVTEQDSKDSTYSLSSTLTLSKADYEKHKVYACEVTHQGLS
SPVTKSFNRGEC

Figure 55C

DVD-Ig

Heavy Chain (SEQ ID NO: 29789)

VH1/ASTKGPSVFPLAP/VH2/ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREE
QYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKT
TPPVLDSDGSFFLYSKLTVDKSRWQQGNVFSCSVMHEALHNHYTQKSLSLSPGK

Light Chain (SEQ ID NO: 29790)

VL1/RTVAAPSVFIFPP/VL2/RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Trident

Heavy Chain 1 (SEQ ID NO: 29791)

VL1/GGGSGGGG/VH1/GGCGGGGEVAACEKEVAALEKEVAALEKEPKSSDKTHTCPPCPAPPVAGPSVFLFPPKPKDTLMISRTPEVTCVVV
DVSHEDPEVKFNWYVDGVEVHNAKTKPREEEYNSTYRVVSVLTVLHQDWLNGKEYKCKVSNKALPAPIEKTISKAKGQFREPQVYTLPPSREMTKNQV
SLTCDVSGFYPSDIAVEWESNGQPENNYKTTPPVLDSDGSFFLYSKLTVDKSRWQQGDVFSCSVMHEALHNHYTQKSLSLSPGK

Heavy Chain 2 (SEQ ID NO: 29792)

VH2/ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVD
KKVERKSCDKTHTCPPCPAPPVAGPSVFLFPPKPKDTLMISRTPEVTCVVVDVSHEDPEVKFKWYVDGVEVHNAKTKPREEQYNSTYRVVSVLTVLHQD
WLNGKEYKCKVSNKALPAPIEKTISKAKGQPREPQVKLTCLVKGFYPSDIAVEWESNGQPENNYKTTPPVLDSDGSFFLYSKLT
VDKSRWQQGNVFSCSVMHEALHNHYTQKSLSLSPGK

Light Chain 1 (SEQ ID NO: 29793)

VL1/GGGSGGGG/VH1/GGCGGGGKVAACKEKVAALKEKVAALKE

Figure 55D

Light Chain 2 (SEQ ID NO: 29794)

VL2/RTVAAPSVFIFPPSDEQLKSGTASVVCLLNNFYPREAKVQWKVDNALQSGNSQESVTEQDSKDSTYSLSSTLTLSKADYEKHKVYACEVTHQGLS
SPVTKSFNRGEC

Figure 56A

XENP18920

>XENP18920 nivolumab[PD-1]_H0L0_Fab-[anti-ICOS]_H0L0_scFv Fab-Fc Heavy Chain (SEQ ID NO: 29795)

QVQLVESGGGVVQPGRSLRLDCKASGITFSNSGMHWVRQAPGKGLEWVAVIWYDGSKRYYADSKPYYADSVKGRFTISRDNSKNTLFLQMNSLRAEDTAVYYCATNDDYWGQGTLV
TVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESDGQPENNYKTTPPVLDSDGSFFLYSKLTVDKSRWQEGDVFSCSVMHEALHNHYTQKS
LSLSPGK

>XENP18920 nivolumab[PD-1]_H0L0_Fab-[anti-ICOS]_H0L0_scFv scFv-Fc Heavy Chain (SEQ ID NO: 29796)

QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLV
TVSS/GKPGSGKPGSGKPGSGKPGS/EIVLTQSPATLSLSPGERATLSCRASQSVSSYLAWYQQKPGQAPRLLIYDASNRATGIPARFSGSGSGTDFTLTISSLEPEDF
AVYYCQQSSNWPRTFGQGTKVEIK/EPKSSDKTHTCPPCPAPPVAGPSVFLFPPKPKDTLMISRTPEVTCVVVDVSHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLFCLVKGFYPSDIAVEWESNGQPENNYKTTPPVLDSDGSFFLYSK
LTVDKSRWQQGNVFSCSVMHEALHNHYTQKSLSLSPGK

>XENP18920 nivolumab[PD-1]_H0L0_scFv Light Chain (SEQ ID NO: 29797)

EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 56B

XENP24130

>XENP024130_LOPD180[PD-1]_H1L1_Fab-[anti-ICOS]_H0L0_scFv Fab-Fc Heavy Chain (SEQ ID NO: 29798)
QVQLQESGPGLVKPSQTLSLTCTVSGGSISSGAYYWSWIRQHPGKGLEWIGYIYYNGNTYYNPSLPSRVTISVDTSKNQFSLKLSSVTAADTAVYYCVRASDYVWGGYH
YFDAFDLWGRGTLVTVSS/ASTKGPSVFPLAPSSKSTSGGTAALGCLVKDYFPEPVTVSWNSGALTSGVHTFPAVLQSSGLYSLSSVVTVPSSSLGTQTFICNVNHKPS
DTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCS
VMHEALHNHYTQKSLSLSPGK >XENP024130_LOPD180[PD-1]_H1L1_Fab-[anti-ICOS]_H0L0_scFv scFv-Fc Heavy Chain (SEQ ID NO: 29799)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYH
DAFDIWGQGTMVTVSS/GKPGSGKPGSGKPGS/DIQMTQSPSSVSASVGDRVTITCRASQGISRLLAWYQQKPGKAPKLLIYVASSLQSGVPSRFSGSGSGTDF
TLTISSLQPEDFATYYCQQANSFPWTFGQGTKVEIK/EPKSSDKTHTCPPCPAPPVAGPSVFLFPPKPKDTLMISRTPEVTCVVVDVKHEDPEVKFNWYVDGVEVHNAK
TKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPV
LDSDGSFFLYSRLTVDKSRWQQGNVFSCSVMHEALHNHYTQKSLSLSPGK >XENP024130_LOPD180[PD-1]_H1L1_Fab-[anti-ICOS]_H0L0_scFv Light Chain (SEQ ID NO: 29800)
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTV
L/GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

Figure 57A

XENP23406

>XENP023406_[anti-ICOS]_H0L0_Fab-[anti-ICOS]_H0L0_Fab-Fc Heavy Chain (SEQ ID NO: 29801)

QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYHDAFDIW
GQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

>XENP023406_[anti-ICOS]_H0L0_Fab-scFv-Fc Heavy Chain (SEQ ID NO: 29802)

QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYHDAFDIW
GQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCG
KPGSGKPGS/EIVLTQSPATLSASPGERVTLTCRASQSVGNDVAWYQQKPGQAPRLLINYASHRYTGSGYGTEFTLTISSVQSEDFGVYYCQQDFSSPRTFGGGTKVE
IK/GKPGSGKPGSGKPGS/EVQLVESGGGLVKPGGSLRLSCVASGFTFSNYWMNWVRQAPGKGLEWVAEIRLKSNNYATHYAESVKGRFTISRDDSKSTLYLQMNNLKTE
DTGVYYCTRNYGNYGGYFDVWGRGTLVTVSS/GGGGSGGGGSKTHTCPPCPAPPVAGPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

>XENP023406_[anti-ICOS]_H0L0_Fab_1G6_L1.194_H1.279_scFv Light Chain (SEQ ID NO: 29803)

DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/RTVAAPS
VFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

XENP23407

>XENP023407_[anti-ICOS]_H0L0_Fab-Fc Heavy Chain (SEQ ID NO: 29804)

QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYHDAFDIW
GQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCD
KTHTCPPCPAPELLGGPSVFLFPPKPKDTLMISRTPEVTCVVVDVSHEDPEVKFNWYVDGVEVHNAKTKPREEYNSTYRVVSVLTVLHQDWLNGKEYKCKVSNKAFPAPIEKTI
SKAKGQPREPQVYTLPPSREEMTKNQVSLTCLVKGFYPSDIAVEWESDGQPENNYKTTPPVLDSDGSFFLYSKLTVDKSRWQQGNVFSCSVMHEALHNHYTQKSLSLSPGK

Figure 57B

>XENP023407 [anti-ICOS]_H0L0_Fab-[anti-ICOS]_H0L0_Fab-1G6_L1.194_H1.279_scFv_Fab-scFv-Fc Heavy Chain (SEQ ID NO: 29805)

QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARHYYDSSGYYHDAFDIW
GQGTMVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCG
KPGSGKPGS/EIVLTQSPATLSASPGERVTITCRASQSVGNDVAWYQQKPGQAPRLLINYASRYTGVPDRFTGSGYGTEFTLTISSVQSEDFGVYYCQQDESSPRTFGGGTKVE
IK/GKPGSGKPGSGKPGS/EVQLVESGGGLVKPGGSLRLSCVASG/GGGSGGGGSGGGGS/DIQMTQSPSSVSASVGDRVTITCRASQGISRLLAWYQQKPGKAPKLLIYAASSLQSGVPSRFSGSGSGTDFTLTIS
DTGVYYCTRYYGNYGGYFDVWGRGTLVTVSS/GGGSGGGGSGGGGS/DIQMTQSPSSVSASVGDRVTITCRASQGISRLLAWYQQKPGKAPKLLIYAASSLQSGVPSRFSGSGSGTDFTLTIS
QYNSTYRVVSVLFVLHQDWLNGKEYKCKVSNKAFPAPIEKTISKAKGQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK

>XENP023407 [anti-ICOS]_H0L0_Fab-[anti-ICOS]_H0L0_Fab-1G6_L1.194_H1.279_scFv Light Chain (SEQ ID NO: 29806)

DIQMTQSPSSVSASVGDRVTITCRASQGISRLLAWYQQKPGKAPKLLIYAASSLQSGVPSRFSGSGSGTDFTLTISSLQPEDFATYYCQQANSFWTFGQGTKVEIK/RTVAAPS
VFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

XENP24128

>XENP024128 1G6_L1.194_H1.279_Fab-1G6_L1.194_H1.279_Fab-scFv Fab-Fc Heavy Chain (SEQ ID NO: 29807)

EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRG
TLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESDGQPENNYKTTPPVLDSDGSFFLYSKLTVDKSRWQEGGVFSCSVMHEALHNHYTQKSLSLSPGK

>XENP024128 1G6_L1.194_H1.279_Fab-1G6_L1.194_H1.279_Fab-scFv Fab-scFv-Fc Heavy Chain (SEQ ID NO: 29808)

EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRG
TLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGKPG
SGKPGS/QVQLVQSGTMVTVSS/GKPGSGKPGSGAEVKKPGASVKVSCKASGYTFTGYYMEWVRQAPGQGLEWMGWINPHSGGTNYAQKFQGRVTMTRDTSISTAYMELSRLSLQSSGVPSRFSGSGSGTDFTLTIS
SGKPGS/QVQLVQSGTMVTVSS/GKPGSGKPGSGAEVKKPGASVKVSCKASGYTFTGYYMEWVRQAPGQGLEWMGWINPHSGGTNYAQKFQGRVTMTRDTSISTAYMELSRLSDDTAVYYCARTYYDSSGYY
HDAFDIWGQGTMVTVSS/GKPGSGKPGSGGGGSGGGGS/DIQMTQSPSSVSASVGDRVTITCRASQGISRLLAWYQQKPGKAPKLLIYAASSLQSGVPSRFSGSGSGTDFTLTIS
SLQPEDFATYYCQQANSFWTFGQGTKVEIK/GGGSGGGGSGGGGS/GKPGSGKPGSGKPGS/
YNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSK
TVDKSRWQQGNVFSCSVMHEALHNHYTQKSLSLSPGK

Figure 57C

>XENP024128_1G6_L1.194_H1.279_Fab-1G6_L1.194_H1.279_Fab_[anti-ICOS]_H0L0_scFv Light Chain (SEQ ID NO: 29809)

EIVLTQSPATLSASPGERVTLTCRASQSVGNDVAWYQQKPGQAPRLLINYASHRYEGVPDRFTGSGYGTEFTLTISSVQSEDFGVYYCQQDESSPRTFGGGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 58

XENP24123

>XENP24123_1G6_H1.279_L1.194_Fab_(G4S)2_[anti-ICOS1_H0L0_scFv20_Fc_IgG1 Heavy Chain (SEQ ID NO: 29810)

EVQLVESGGGLVKPGGSLRLSCVASGFTFSNYWMNWVRQAPGKGLEWVAEIRLKSNNYATHYAESVKGRFTISRDDSKSTLYLQMNNLKTEDTGVYYCTRYYGNYGYE
DVWGRGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCGGGGSGGGGS/QVQLVQSGAEVKKPGASVKVSCKASGYTFTGYYMHWVRQAPGQGLEWMGWINPHSGGTNYAQKFQGRVTMTRDTSISTAYMELSRLRSDD
TAVYYCARTYYYDSSGYYHDAFDIWGQGTMVTVSS/GGGGSGGGGSGGGGS/DIQMTQSPSSVSASVGDRVTITCRASQGISRLLAWYQQKPGKAPKLLIYYAS
SLQSGVPSRFSGSGSGTDFTLTISSLQPEDFATYYCQQANSFPWTFGQGTKVEIK/GGGGSGGGGSGGGGSFPWTFGQGTKVEIK/GGGGSGGGGSGGGGSKTHTCPPCPAPPVAGPSVFLFPPKPKDTLMISRTPEVT
CVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLV
KGFYPSDIAVEWESNGQPENNYKTTPPVLDSDGSFFLYSKLTVDKSRWQQGNVFSCSVMHEALHNHYTQKSLSLSPGK

>XENP24123_1G6_H1.279_L1.194_Fab_(G4S)2_[anti-ICOS1_H0L0_scFv20_Fc_IgG1 Light Chain (SEQ ID NO: 29811)

EIVLTQSPATLSASPGERVTLTCRASQSVGNDVAWYQQKPGQAPRLLINYASHRYTGVPDRFTGSGYGTEFTLTISSVQSEDFGVYYCQQDESSPRTFGGGTKVEIK/R
TVAAPSVFIFPPSDEQLKSGTASVVCLLNNFYPREAKVQNKVDNALQSGNSQESVTEQDSKDSTYSLSSTLTLSKADYEKHKVYACEVTHQGLSSPVTKSFNRGEC

XENP24125

>XENP24125_LOPD180[PD-1]_H1L1_Fab_(G4S)2_[anti-ICOS1_H0L0_scFv20_Fc_IgG1 Heavy Chain (SEQ ID NO: 29812)

QVQLQESGPGLVKPSQTLSLTCTVSGGSISSSGAYYWSWIRQHPGKGLEWIGYIYYNGNTYYNPSLRSRVTISVDTSKNQFSLKLSSVTAADTAVYYCVRASDYWGGYE
YEDAFDLWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCGGGGSGGGGS/QVQLVQSGAEVKKPGASVKVSCKASGYTFTGYYMHWVRQAPGQGLEWMGWINPHSGGTNYAQKFQGRVTMTRDTSISTAYMELSR
LRSDDTAVYYCARTYYYDSSGYYHDAFDIWGQGTMVTVSS/GGGGSGGGGSGGGGS/DIQMTQSPSSVSASVGDRVTITCRASQGISRLLAWYQQKPGKAPKLL
IYYASSLQSGVPSRFSGSGSGTDFTLTISSLQPEDFATYYCQQANSFPWTFGQGTKVEIK/GGGGSGGGGSGGGGSNKALPAPIEKTISKAKGQPREPQVYTLPPSREEMTKNQVSLTCLV
CVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLV
KGFYPSDIAVEWESNGQPENNYKTTPPVLDSDGSFFLYSKLTVDKSRWQQGNVFSCSVMHEALHNHYTQKSLSLSPGK

>XENP24125_LOPD180[PD-1]_H1L1_Fab_(G4S)2_[anti-ICOS1_H0L0_scFv20_Fc_IgG1 Light Chain (SEQ ID NO: 29813)

QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTV
L/GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

Figure 59

>XENP024134_1G6_H1.279_L1.194_Fab-[anti-ICOS]_H0L0_Fab-IgG1 Heavy Chain 1 (SEQ ID NO: 29814)
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYF
DVWGRGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGDVFSCSVMHEA
LHNHYTQKSLSLSPGK >XENP024134_1G6_H1.279_L1.194_Fab-[anti-ICOS]_H0L0_Fab-IgG1 Heavy Chain 2 (SEQ ID NO: 29815)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYDSSGYYH
DAFDIWGQGTMVTVSS/ASTKGPSVFPLAPSSKSTSGGTAALGCLVKDYFPEPVTVSWNSGALTSGVHTFPAVLQSSGLYSLSSVVTVPSSSLGTKTYTCNVNHKPSNT
KVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEY
KCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK >XENP024134_1G6_H1.279_L1.194_Fab-[anti-ICOS]_H0L0_Fab-IgG1 Light Chain 1 (SEQ ID NO: 29816)
EIVLTQSPATLSASPGERVTLTCRASQSVGNDVAWYQQKPGQAPRLLINYASHRYTGVPDRFTGSGYGTEFTLTISSVQSEDFGVYYCQQDESSPRTFGGGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP024134_1G6_H1.279_L1.194_Fab-[anti-ICOS]_H0L0_Fab-IgG1 Light Chain 2 (SEQ ID NO: 29817)
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 60

>XENP024122_1G6_H1.279_L1.194_[anti-ICOS]_H0L0_IgG1 Heavy Chain (SEQ ID NO: 29818)
EVQLVESGGGLVKPGGSLRLSCVASGFTFSNYWMNWVRQAPGKGLEWVAEIRLKSNNYATHYAESVKGRFTISRDDSKSTLYLQMNNLKTEDTGVYYCTRYYGNIGGYF
DYWGRGTLVTVSS/ASTKGPSVFPLAP/QVQLVQSGAEVKKPGASVKVSCKASGYTFTGYYMHWVRQAPGQGLEWMGWINPHSGGTNYAQKFQGRVTMTRDTSISTAYM
ELSRLRSDDTAVYYCARTYYDSSGYHDAFDIWGQGTMVTVSS/ASTKGPSVFPLAPSSKSTSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDS
DGSFFLYSKLTVDKSRWQQGNVFSCSVMHEALHNHYTQKSLSLSPGK >XENP024122_1G6_H1.279_L1.194_[anti-ICOS]_H0L0_IgG1 Light Chain (SEQ ID NO: 29819)
EIVLTQSPATLSASPGERVTLFCRASQSVGNDVAWYQQKPGQAPRLLINYASHRYTGVPDRFTGSGYGTEFTLTISSVQSEDRGVYYCQQDESSFRTFGGGTKVEIK/R
TVAAPSVFIFPP/DIQMTQSPSSVSASVGDRVTITCRASQGISRLLAWYQQKPGKAFKLLIYVASSLQSGVPSRFSGSGSGTDFTLTISSLQPEDFATYYCQQANSFPW
TFGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSP
VTKSFNRGEC

Figure 61A

XENP24132

>XENP24132_1G6_L1.194_1G6_H1.279_DART-[anti-ICOS]_H0L0_Fab-Fc_IgG1_Heavy Chain 1 (SEQ ID NO: 29820)
EIVLTQSPATLSASPGERVTLTCRASQSVGNDVAWYQQKPGQAPRLLINYASHRYTGVPDRFTGSSGYGTEFTLTISSVQSEDFGVYYCQQDFSSPRTFGGGTKVEIK/G
GGSGGGG/EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRY
YGNYGGYFDVWGRGTLVTVSS/GGCGGGEVAACEKEVAALEKEVKCKVSNKALPAPIEKTISKAKGQPREPQVYTLPPSREEMTKNQVSLTCDVSGFYPSDIA
DPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWQQGNVFSCSVMHEALHNHYTQKSLSLSPGK >XENP24132_1G6_L1.194_1G6_H1.279_DART-[anti-ICOS]_H0L0_Fab-Fc_IgG1_Heavy Chain 2 (SEQ ID NO: 29821)
QVQLVQSGAEVKKPGASVKVSCKASGYTFTGYMHWVRQAPGQGLEWMGWINPHSGGTNYAQKFQGRVTMTRDTSISTAYMELSRLRSDDTAVYYCARTYYDSSGYYH
DAFDIWGQGTMVTVSS/ASTKGPSVFPLAPSSKSTSGGTAALGCLVKDYFPEPVTVSWNSGALTSGVHTFPAVLQSSGLYSLSSVVTVPSSSLGTKTYTCNVNHKPSNT
KVDKKVERKSCDKTHTCPRCPAPPVAGPSVFLFPPKPKDTLMISRTPEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK >XENP24132_1G6_L1.194_1G6_H1.279_DART-[anti-ICOS]_H0L0_Fab-Fc_IgG1_Light Chain 1 (SEQ ID NO: 29822)
EIVLTQSPATLSASPGERVTLTCRASQSVGNDVAWYQQKPGQAPRLLINYASHRYTGVPDRFTGSSGYGTEFTLTISSVQSEDFGVYYCQQDFSSPRTFGGGTKVEIK/G
GGSGGGG/EVQLVESGGGLVKPGGSLRLSCVASGFTFSNYWMNWVRQAPGKGLEWVAEIRLYSNNYATHYAESVKGRFTISRDDSKSTLYLQMNNLKTE
DTGVYYCTRYYGNYGGYFDVWGRGTLVTVSS/GGCGGGKVAACEKEVAALKEKVAALKE >XENP24132_1G6_L1.194_1G6_H1.279_DART-[anti-ICOS]_H0L0_Fab-Fc_IgG1_Light Chain 2 (SEQ ID NO: 29823)
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

XENP24133

>XENP24133_mAb7(1.2)[PD-1]_L1_mAb7(1.2)[PD-1]_H1_DART-[anti-ICOS]_H0L0_Fab-Fc_IgG1_Heavy Chain 1 (SEQ ID NO: 29824)
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVE
IK/GGGSGGGG/QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCA
RERYGTSPFAYWGQGTLVTVSS/GGCGGGEVAACEKEVAALEKEVKCKVSNKALPAPIEKTISKAKGQPREPQVYTLPPSREEMTKNQVSLTCDVSGFYPSDI
EDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

Figure 61B

>XENP024133_mAb7(1.2)_[PD-1]_L1_mAb7(1.2)_[PD-1]_H1_DART-[anti-ICOS]_H0L0_Fab-Fc_IgG1 Heavy Chain 2 (SEQ ID NO: 29825)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYH
DAFDIWGQGTMVTVSS/ASTKGPSVFPLAPSSKSTSGGTAALGCLVKDYFPEPVTVSWNSGALTSGVHTFPAVLQSSGLYSLSSVVTVPSSSLGTKTYTCNVNHKPSNT
KVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEY
KCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK >XENP024133_mAb7(1.2)_[PD-1]_L1_mAb7(1.2)_[PD-1]_H1_DART-[anti-ICOS]_H0L0_Fab-Fc_IgG1 Light Chain 1 (SEQ ID NO: 29826)
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVE
IK/GGGSGGGG/QVQLVQSGAEVKKPGASVKVSCKAGASVFTSYWMNWVRQAPGQGLEWIGVIHPSDSETWLDQSFKDRVTITVDKSTSTAYMELSSLR
SEDTAVYYCAREHYGTSFFAYWGQGTLVTVSS/GGCGGGKVAACKEKVAALKEKVAALKE >XENP024133_mAb7(1.2)_[PD-1]_L1_mAb7(1.2)_[PD-1]_H1_DART-[anti-ICOS]_H0L0_Fab-Fc_IgG1 Light Chain 2 (SEQ ID NO: 29827)
DIQMTQSPSSVSASVGDRVTITCRASQGISRLLAWYQQKPGKAPKLLIYVASSLQSGVPSRFSGSGSGTDFTLTISSLQPEDFATYCQQANSFWLFGQGTKVEIK/R
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 63

>XENP021749_[anti-ICOS]_H0L0_Fab-[anti-CTLA-4]_H3.23_L0.129_scFv Fab-Fc Heavy
Chain (SEQ ID NO: 29828)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYBDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP021749_[anti-ICOS]_H0L0_Fab-[anti-CTLA-4]_H3.23_L0.129_scFv scFv-Fc
Heavy Chain (SEQ ID NO: 29829)

EVQLVESGGGLVKPGGSLRLSCAASGFTFSSYTMHWVRQAPGKGLEWVSFISYDGNYKYYADSVKGRFTISRDNAKN
SLYLQMNSLRAEDTAVYYCARGGHLGPFDLWGQGTMVTVSS/GKPGSGKPGSGKPGSGKPGS/EIVLTQSPATLSLS
PGERATLSCRASQSVGSSYLAWYQQKPGQAPRLLIYGASSRATGIPDRFSGSGSGTDFTLTISRLEPEDFAVYYCQQ
YGSSPWTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVLTCLVKGFYPSDIAVEWESNGQPENNYKTTPPVLDSDGSFFLYSKLTVDKSRWQQGNVFSCSVMH
EALHNHYTQKSLSLSPGK

>XENP021749_[anti-ICOS]_H0L0_Fab-[anti-CTLA-4]_H3.23_L0.129_scFv Light Chain
(SEQ ID NO: 29830)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64A

XENP24359

>XENP024359 7G8_H3.30_L1.34_Fab-[anti-ICOS]_H0L0_Fab Heavy Chain 1 (SEQ ID NO: 29831)

EVQLVESGGGLVQPGGSLRLSCAASGFTFDDAWMSWVRQAPGKGLEWVAEISTKANNHATYYAESVKGRFTISRDDS
KSSVYLQMNSLRAEDTAVYYCTRLATWDWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

>XENP024359 7G8_H3.30_L1.34_Fab-[anti-ICOS]_H0L0_Fab Heavy Chain 2 (SEQ ID NO: 29832)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTKTYTCNVNHKPSNTKVDKKVERKSCDK
THTCPRCPAPPVAGPSVFLFPPKPKDTLMISRTPEVTCVVVDVKHEDPEVKFKWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

>XENP024359 7G8_H3.30_L1.34_Fab-[anti-ICOS]_H0L0_Fab Light Chain 1 (SEQ ID NO: 29833)

DIVLTQSPSSLSASVGDRVTITCRASQSVDYDGDSYMNWYQQKPGKPPKLLIYAASELESGIPARFSGSGSGTDFTL
TISSLQPEDFATYYCQQSNEDPFTFGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024359 7G8_H3.30_L1.34_Fab-[anti-ICOS]_H0L0_Fab Light Chain 2 (SEQ ID NO: 29834)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP24360

>XENP024360 2A11_H1.144_L2.142_Fab-[anti-ICOS]_H0L0_Fab Heavy Chain 1 (SEQ ID NO: 29835)

EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDIWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Figure 64B

>XENP024360_2A11_H1.144_L2.142_Fab-[anti-ICOS]_H0L0_Fab Heavy Chain 2 (SEQ ID NO: 29836)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTKTYTCNVNHKPSNTKVDKKVERKSCDK
THTCPRCPAPPVAGPSVFLFPPKPKDTLMISRTPEVTCVVVDVKHEDPEVKFKWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

>XENP024360_2A11_H1.144_L2.142_Fab-[anti-ICOS]_H0L0_Fab Light Chain 1 (SEQ ID NO: 29837)

DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024360_2A11_H1.144_L2.142_Fab-[anti-ICOS]_H0L0_Fab Light Chain 2 (SEQ ID NO: 29838)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 65

>XENP024361_3H3_H1_L2.1_Fab-[anti-ICOS]_H0L0_Fab Heavy Chain 1 (SEQ ID NO 29839)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK >XENP024361_3H3_H1_L2.1_Fab-[anti-ICOS]_H0L0_Fab Heavy Chain 2 (SEQ ID NO 29840)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTKTYTCNVNHKPSNTKVDKKVERKSCDK
THTCPRCPAPPVAGPSVFLFPPKPKDTLMISRTPEVTCVVVDVKHEDPEVKFKWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK >XENP024361_3H3_H1_L2.1_Fab-[anti-ICOS]_H0L0_Fab Light Chain 1 (SEQ ID NO 29841)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP024361_3H3_H1_L2.1_Fab-[anti-ICOS]_H0L0_Fab Light Chain 2 (SEQ ID NO 29842)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 66A

XENP21748

>XENP021748 YW243.55.S70[PD-L1]_H0L0_Fab-[anti-ICOS]_H0L0_scFv Fab-Fc Heavy
Chain (SEQ ID NO: 29843)

EVQLVESGGGLVQPGGSLRLSCAASGFTFSDSWIHWVRQAPGKGLEWVAWISPYGGSTYYADSVKGRFTISADTSKN
TAYLQMNSLRAEDTAVYYCARRHWPGGFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

>XENP021748 YW243.55.S70[PD-L1]_H0L0_Fab-[anti-ICOS]_H0L0_scFv scFv-Fc Heavy
Chain (SEQ ID NO: 29844)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/GKPGSGKPGSGKPGSGKPGS/DIQMTQS
PSSVSASVGDRVTITCRASQGISRLLAWYQQKPGKAPKLLIYVASSLQSGVPSRFSGSGSGTDFTLTISSLQPEDFA
TYYCQQANSFPWTFGQGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP021748 YW243.55.S70[PD-L1]_H0L0_Fab-[anti-ICOS]_H0L0_scFv Light Chain
(SEQ ID NO: 29845)

DIQMTQSPSSLSASVGDRVTITCRASQDVSTAVAWYQQKPGKAPKLLIYSASFLYSGVPSRFSGSGSGTDFTLTISS
LQPEDFATYYCQQYLYHPATFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP24129

>XENP024129 durvalumab[PD-L1]_H1L1_Fab-[anti-ICOS]_H0L0_scFv Fab-Fc Heavy
Chain (SEQ ID NO: 29846)

EVQLVESGGGLVQPGGSLRLSCAASGFTFSRYWMSWVRQAPGKGLEWVANIKQDGSEKYYVDSVKGRFTISRDNAKN
SLYLQMNSLRAEDTAVYYCAREGGWFGELAFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Figure 66B

>XENP024129 durvalumab[PD-L1]_H1L1_Fab-[anti-ICOS]_H0L0_scFv scFv-Fc Heavy Chain (SEQ ID NO: 29847)

QVQLVQSGAEVKKPGASVKVSCKASGYTFT<u>GYYMH</u>WVRQAPGQGLEWMG<u>WINPHSGGTNYAQKFQG</u>RVTMTRDTSIS
TAYMELSRLRSDDTAVYYCAR<u>TYYYDSSGIYHDAFDI</u>WGQGTMVTVSS/<u>GKPGSGKPGSGKPGSGKPGS</u>/DIQMTQS
PSSVSASVGDRVTITC<u>RASQGISRLLA</u>WYQQKPGKAPKLLIY<u>VASSLQS</u>GVPSRFSGSGSGTDFTLTISSLQPEDFA
TYYC<u>QQANSFPWT</u>FGQGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP024129 durvalumab[PD-L1]_H1L1_Fab-[anti-ICOS]_H0L0_scFv Light Chain (SEQ ID NO: 29848)

EIVLTQSPGTLSLSPGERATLSC<u>RASQRVSSSYLA</u>WYQQKPGQAPRLLIY<u>DASSRAT</u>GIPDRFSGSGSGTDFTLTIS
RLEPEDFAVYYC<u>QQYGSLFWT</u>FGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

XENP24131

>XENP024131 avelumab[PD-L1]_H1L1_Fab-[anti-ICOS]_H0L0_scFv Fab-Fc Heavy Chain (SEQ ID NO: 29849)

EVQLLESGGGLVQPGGSLRLSCAASGFTFS<u>SYIMM</u>WVRQAPGKGLEWVS<u>SIYPSGGITFYADTVKG</u>RFTISRDNSKN
TLYLQMNSLRAEDTAVYYCAR<u>IKLGTVTTVDY</u>WGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

>XENP024131 avelumab[PD-L1]_H1L1_Fab-[anti-ICOS]_H0L0_scFv scFv-Fc Heavy Chain (SEQ ID NO: 29850)

QVQLVQSGAEVKKPGASVKVSCKASGYTFT<u>GYYMH</u>WVRQAPGQGLEWMG<u>WINPHSGGTNYAQKFQG</u>RVTMTRDTSIS
TAYMELSRLRSDDTAVYYCAR<u>TYYYDSSGYYHDAFDI</u>WGQGTMVTVSS/<u>GKPGSGKPGSGKPGSGKPGS</u>/DIQMTQS
PSSVSASVGDRVTITC<u>RASQGISRLLA</u>WYQQKPGKAPKLLIY<u>VASSLQS</u>GVPSRFSGSGSGTDFTLTISSLQPEDFA
TYYC<u>QQANSFPWT</u>FGQGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP024131 avelumab[PD-L1]_H1L1_Fab-[anti-ICOS]_H0L0_scFv Light Chain (SEQ ID NO: 29851)

QSALTQPASVSGSPGQSITISC<u>TGTSSDVGGYNYVS</u>WYQQHPGKAPKLMIY<u>DVSNRPS</u>GVSNRFSGSKSGNTASLTI
SGLQAEDEADYYC<u>SSYTSSSTRV</u>FGTGTKVTVL/GQPKAAPSVTLFPPSSEELQANKATLVCLISDFYPGAVTVAWK
ADSSPVKAGVETTTPSKQSNNKYAASSYLSLTPEQWKSHRSYSCQVTHEGSTVEKTVAPTECS

Figure 66C

XENP24124

>XENP024124 durvalumab[PD-L1]_H1L1_Fab_(G4S)2_[anti-ICOS]_H0L0_scFv20_Fc_IgG1
Heavy Chain (SEQ ID NO: 29852)

EVQLVESGGGLVQPGGSLRLSCAASGFTFSRYWMSWVRQAPGKGLEWVANIKQDGSEKYYVDSVKGRFTISRDNAKN
SLYLQMNSLRAEDTAVYYCAREGGWFGELAFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCGGGGSG
GGGS/QVQLVQSGAEVKKPGASVKVSCKASGYTFTGYYMHWVRQAPGQGLEWMGWINPHSGGTNYAQKFQGRVTMTR
DTSISTAYMELSRLRSDDTAVYYCARTYYYDSSGYYHDAFDIWGQGTMVTVSS/GGGGSGGGGSGGGGSGGGGS/DI
QMTQSPSSVSASVGDRVTITCRASQGISRLLAWYQQKPGKAPKLLIYVASSLQSGVPSRFSGSGSGTDFTLTISSLQ
PEDFATYYCQQANSFPWTFGQGTKVEIK/GGGGSGGGGSKTHTCPPCPAPPVAGPSVFLFPPKPKDTLMISRTPEVT
CVVVDVKHEDPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

>XENP024124 durvalumab[PD-L1]_H1L1_Fab_(G4S)2_[anti-ICOS]_H0L0_scFv20_Fc_IgG1
Light Chain (SEQ ID NO: 29853)

EIVLTQSPGTLSLSPGERATLSCRASQRVSSSYLAWYQQKPGQAPRLLIYDASSRATGIPDRFSGSGSGTDFTLTIS
RLEPEDFAVYYCQQYGSLPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

Figure 68A

XENP20266

>XENP020266 [ICOS]_H0L0 one-arm mAb Fab-Fc Heavy Chain (SEQ ID NO: 29854)

QVQLVQSGAEVKKPGASVKVSCKASGYTFT GYYMH WVRQAPGQGLEWMG WINPHSGGTNYAQKFQG RVTMTRDTSIS
TAYMELSRLRSDDTAVYYCAR TYYDSSGIYRDAFDI WGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP020266 [ICOS]_H0L0 one-arm mAb Fc-only Heavy Chain (SEQ ID NO: 29855)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP020266 [ICOS]_H0L0 one-arm mAb Light Chain (SEQ ID NO: 29856)

DIQMTQSPSSVSASVGDRVTITC RASQGISRLLA WYQQKPGKAPKLLIY VASSLQS GVPSRFSGSGSGTDFTLTISS
LQPEDFATYYC QQANSFPWT FGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP21861

>XENP021861 GSK_314.8[ICOS]_H0L0 one-arm mAb Fab-Fc Heavy Chain (SEQ ID NO: 29857)

QVQLQQPGTELMKPGASVKLSCKASGYTFT TYWMH WVKQRPGQGLEWIG EIDPSDSYVNYNQNFKG KATLTVDKSSS
TAYIQLSSLTSEDSAVYFCAR SPDYYGTSLAWFDY WGQGTLVTVST/ASTKGPSVFPLAPSSKSTSGGTAALGCLVK
DYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYNSTYRV
VSVLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

>XENP021861 GSK_314.8[ICOS]_H0L0 one-arm mAb Fc-only Heavy Chain (SEQ ID NO: 29858)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP021861 GSK_314.8[ICOS]_H0L0 one-arm mAb Light Chain (SEQ ID NO: 29859)

DIVMTQAAPSVPVTPGESVSISC RSSKSPLHSNGNIYLY WFLQRPGQSPQLLIY RMSNLAS GVPDRFSGSGSGTTFT
LKISRVEAEDVGVYYC MQHLEYPYT FGGGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 688

XENP21863

>XENP021863 jMab-138[ICOS]_H0L0 one-arm mAb Fab-Fc Heavy Chain (SEQ ID NO: 29860)

EVQLVESGGGLVQPGGSLRLSCAASGFTFSSYDMHWVRQATGKGLEWVSAIGTAGDTYYPGSVKGRFTISRENAKNSLYLQM
NSLRAGDTAVYYCVRDNRKVTHEHYYYYGMDVWGQGTTVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

>XENP021863 jMab-138[ICOS]_H0L0 one-arm mAb Fc-only Heavy Chain (SEQ ID NO: 29861)

ERKSSDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK

>XENP021863 jMab-138[ICOS]_H0L0 one-arm mAb Light Chain (SEQ ID NO: 29862)

EIVLTQSPGTLSLSPGERATLSCRASQNIPSSYLAWYQQKPGQAPGLLIYGASSRATGIPDRFSGSGSGTDFTLTISRLEPE
DFAVYYCQQFGSSPMCSFGQGTKLEIK/RTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

XENP22349

>XENP022349 WO2016059602[ICOS]_GSK_H0L0 one-arm mAb Fab-Fc Heavy Chain (SEQ ID NO: 29863)

QVQLVQSGAEVKKPGSSVKVSCKASGYTFTDYAMHWVRQAPGQGLEWMGLISIYSDHTNYNQKFQGRVTITADKSTSTAYME
LSSLRSEDTAVYYCGRNNYGNYGWYFDVWGQGTTVTVSS/ASTKGPSVFPLAPSSKSTSGGTAALGCLVKDYFPEPVTVSWN
SGALTSGVHTFPAVLQSSGLYSLSSVVTVPSSSLGTQTYICNVNHKPSDTKVDKKVEPKSCDKTHTCPPCPAPPVAGPSVFL
FPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVMHEALHNHYTQKSLSLSPGK

>XENP022349 WO2016059602[ICOS]_GSK_H0L0 one-arm mAb Fc-only Heavy Chain (SEQ ID NO: 29864)

ERKSSDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK

>XENP022349 WO2016059602[ICOS]_GSK_H0L0 one-arm mAb Light Chain (SEQ ID NO: 29865)

EIVLTQSPATLSLSPGERATLSCSASSSVSYMHWYQQKPGQAPRLLIYDTSKLASGIPARFSGSGSGTDYTLTISSLEPEDF
AVYYCFQGSGYPYTFGQGTKLEIK/RTVAAPSVFIFPPSDEQLKSGTASVVCLLNNFYPREAKVQWKVDNALQSGNSQESVT
EQDSKDSTYSLSSTLTLSKADYEKHKVYACEVTHQGLSSPVTKSFNRGEC

Figure 68C

XENP22439

>XENP022439 [ICOS]_H0_L0.5 one-arm mAb Fab-Fc Heavy Chain (SEQ ID NO: 29866)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022439 [ICOS]_H0_L0.5 one-arm mAb Fc-only Heavy Chain (SEQ ID NO: 29867)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022439 [ICOS]_H0_L0.5 one-arm mAb Light Chain (SEQ ID NO: 29868)

DIQMTQSPSSVSASVGDRVTITCRASQGISSLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP22440

>XENP022440 [ICOS]_H0_L0.7 one-arm mAb Fab-Fc Heavy Chain (SEQ ID NO: 29869)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022440 [ICOS]_H0_L0.7 one-arm mAb Fc-only Heavy Chain (SEQ ID NO: 29870)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022440 [ICOS]_H0_L0.7 one-arm mAb Light Chain (SEQ ID NO: 29871)

DIQMTQSPSSVSASVGDRVTITCRASQGISSYLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 68D

XENP22441

>XENP022441 [ICOS]_H0_L0.9 one-arm mAb Fab-Fc Heavy Chain (SEQ ID NO: 29872)

QVQLVQSGAEVKKPGASVKVSCKASGYTFT<u>GYYMH</u>WVRQAPGQGLEWMG<u>WINPHSGGTNYAQKFQG</u>RVTMTRDTSIS
TAYMELSRLRSDDTAVYYCAR<u>TYYYDSSGIYHDAFDI</u>WGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022441 [ICOS]_H0_L0.9 one-arm mAb Fc-only Heavy Chain (SEQ ID NO: 29873)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022441 [ICOS]_H0_L0.9 one-arm mAb Light Chain (SEQ ID NO: 29874)

DIQMTQSPSSVSASVGDRVTITC<u>RASQGISRYLA</u>WYQQKPGKAPKLLIY<u>AASSLQS</u>GVPSRFSGSGSGTDFTLTISS
LQPEDFATYYC<u>QQANSFPWT</u>FGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP22442

>XENP022442 [ICOS]_H0_L0.10 one-arm mAb Fab-Fc Heavy Chain (SEQ ID NO: 29875)

QVQLVQSGAEVKKPGASVKVSCKASGYTFT<u>GYYMH</u>WVRQAPGQGLEWMG<u>WINPHSGGTNYAQKFQG</u>RVTMTRDTSIS
TAYMELSRLRSDDTAVYYCAR<u>TYYYDSSGYYHDAFDI</u>WGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022442 [ICOS]_H0_L0.10 one-arm mAb Fc-only Heavy Chain (SEQ ID NO: 29876)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022442 [ICOS]_H0_L0.10 one-arm mAb Light Chain (SEQ ID NO: 29877)

DIQMTQSPSSVSASVGDRVTITC<u>RASQGISRLLA</u>WYQQKPGKAPKLLIY<u>AASSLQS</u>GVPSRFSGSGSGTDFTLTISS
LQPEDFATYYC<u>QQANSFPWT</u>FGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 68E

XENP22443

>XENP022443 [ICOS]_H0_L0.14 one-arm mAb Fab-Fc Heavy Chain (SEQ ID NO: 29878)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022443 [ICOS]_H0_L0.14 one-arm mAb Fc-only Heavy Chain (SEQ ID NO: 29879)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022443 [ICOS]_H0_L0.14 one-arm mAb Light Chain (SEQ ID NO: 29880)

DIQMTQSPSSVSASVGDRVTITCRASQGISRLLAWYQQKPGKAPKLLIYVASSLQSGVPSRFSGSGSGTDFTLTISS
LQPEDFATYYCQQSNSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP22444

>XENP022444 [ICOS]_H0_L0.15 one-arm mAb Fab-Fc Heavy Chain (SEQ ID NO: 29881)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022444 [ICOS]_H0_L0.15 one-arm mAb Fc-only Heavy Chain (SEQ ID NO: 29882)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022444 [ICOS]_H0_L0.15 one-arm mAb Light Chain (SEQ ID NO: 29883)

DIQMTQSPSSVSASVGDRVTITCRASQGISRLLAWYQQKPGKAPKLLIYVASSLQSGVPSRFSGSGSGTDFTLTISS
LQPEDFATYYCQQAESFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 68F

XENP22445

>XENP022445 [ICOS]_H0_L0.20 one-arm mAb Fab-Fc Heavy Chain (SEQ ID NO: 29884)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022445 [ICOS]_H0_L0.20 one-arm mAb Fc-only Heavy Chain (SEQ ID NO: 29885)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022445 [ICOS]_H0_L0.20 one-arm mAb Light Chain (SEQ ID NO: 29886)

DIQMTQSPSSVSASVGDRVTITCRASQGISRLLAWYQQKPGKAPKLLIYAASSLQSGVPSRFSGSGSGTDFTLTISS
LQPEDFATYYCQQANSYPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENP22766

>XENP022766 [ICOS]_H0_L0.38 one-arm mAb Fab-Fc Heavy Chain (SEQ ID NO: 29887)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

>XENP022766 [ICOS]_H0_L0.38 one-arm mAb Fc-only Heavy Chain (SEQ ID NO: 29888)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP022766 [ICOS]_H0_L0.38 one-arm mAb Light Chain (SEQ ID NO: 29889)

DIQMTQSPSSVSASVGDRVTITCQASQDISSLLAWYQQKPGKAPKLLIYAASSLQSGVPSRFSGSGSGTDFTLTISS
LQPEDFATYYCQQAESFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 68G

XENP23096

\>XENP023096 [ICOS]_H0.66_L0 one-arm mAb Fab-Fc Heavy Chain (SEQ ID NO: 29890)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

\>XENP023096 [ICOS]_H0.66_L0 one-arm mAb Fc-only Heavy Chain (SEQ ID NO: 29891)

ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

\>XENP023096 [ICOS]_H0.66_L0 one-arm mAb Light Chain (SEQ ID NO: 29892)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 69

| XENP | Antigen | K$_D$ (nM) | k$_a$ (1/Ms) | k$_d$ (1/s) |
|---|---|---|---|---|
| 22445 | huICOS | 3.239 | 2.35E+05 | 7.60E-04 |
| 22444 | huICOS | 1.594 | 2.40E+05 | 3.83E-04 |
| 22443 | huICOS | 1.415 | 2.69E+05 | 3.80E-04 |
| 22442 | huICOS | 2.813 | 2.58E+05 | 7.26E-04 |
| 22441 | huICOS | 5.596 | 2.39E+05 | 1.34E-03 |
| 22440 | huICOS | 4.128 | 2.08E+05 | 8.57E-04 |
| 22439 | huICOS | 0.6324 | 1.80E+05 | 1.14E-04 |
| 20266 | huICOS | 1.502 | 2.34E+05 | 3.52E-04 |

Figure 72A

Prototype Costim x PD-1 Bispecific

>XENP023377 11D4[OX40]_H0L0_Fab-1G6_L1.194_H1.279_scFv Fab-Fc Heavy Chain (SEQ ID NO: 29893)
EVQLVESGGGLVQPGGSLRLSCAASGFTFSSYSMNWVRQAPGKGLEWVSYISSSSSTIDYADSVKGRFTISRDNAKNSL
YLQMNSLRDEDTAVYYCARESGWYLFDYWGQGTLVTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK >XENP023377 11D4[OX40]_H0L0_Fab-1G6_L1.194_H1.279_scFv scFv-Fc Heavy Chain (SEQ ID NO: 29894)
EIVLTQSPATLSASPGERVTLTCRASQSVGNDVAWYQQKPGQAPRLLINYASHRYTGVPDRFTGSGYGTEFTLTISSVQS
EDFGVYYCQQDFSSPRTFGGGTKVEIK/GKPGSGKPGSGKPGSGKPGS/EVQLVESGGGLVKPGGSLRLSCVASGFTFS
NYWMNWVRQAPGKGLEWVAEIRLYSNNYATHYAESVKGRFTISRDDSKSTLYLQMNNLKTEDTGVYYCTRYYGNYG
GYFDVWGRGTLVTVSS/EPKSSDKTHTCPPCPAPPVAGPSVFLFPPKPKDTLMISRTPEVTCVVVDVKHEDPEVKFNWY
VDGVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP023377 11D4[OX40]_H0L0_Fab-1G6_L1.194_H1.279_scFv Light Chain (SEQ ID NO: 29895)
DIQMTQSPSSLSASVGDRVTITCRASQGISSWLAWYQQKPEKAPKSLIYAASSLQSGVPSRFSGSGSGTDFTLTISSLQPE
DFATYYCQQYNSYPPTFGGGTKVEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC >XENP023378 1D8[GITR]_H0L0_Fab-1G6_L1.194_H1.279_scFv Fab-Fc Heavy Chain (SEQ ID NO: 29896)
QVTLKESGPGILKPSQTLSLTCSFSGFSLSTSGMGVGWIRQPSGKGLEWLAHIWWDDDKYYSPSLKSQLTISKDTSRNQ
VFLKITSLDTADTATYYCVRSYYYGSSGAMDYWGQGTSVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPENNY
KTTPPVLDSDGSFFLYSKLTVDKSRWEQGDVFSCSVMHEALHNHYTQKSLSLSPGK >XENP023378 1D8[GITR]_H0L0_Fab-1G6_L1.194_H1.279_scFv scFv-Fc Heavy Chain (SEQ ID NO: 29897)
EIVLTQSPATLSASPGERVTLTCRASQSVGNDVAWYQQKPGQAPRLLINYASHRYTGVPDRFTGSGYGTEFTLTISSVQS
EDFGVYYCQQDFSSPRTFGGGTKVEIK/GKPGSGKPGSGKPGSGKPGS/EVQLVESGGGLVKPGGSLRLSCVASGFTFS
NYWMNWVRQAPGKGLEWVAEIRLYSNNYATHYAESVKGRFTISRDDSKSTLYLQMNNLKTEDTGVYYCTRYYGNYG
GYFDVWGRGTLVTVSS/EPKSSDKTHTCPPCPAPPVAGPSVFLFPPKPKDTLMISRTPEVTCVVVDVKHEDPEVKFNWY
VDGVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 72B

>XENP023378 1D8[GITR]_H0L0_Fab-1G6_L1.194_H1.279_scFv Light Chain (SEQ ID NO: 29898)
DIVMTQTPLSLPVSLGDQASISCRSSQSLVHSDGNTYLHWYLQKPGQSPKLLIYKVSKRFSGVPDRFSGSGSGTDFTLKIS
RVEAEDLGVYFCSQSTHVPPTFGGGTKLEIK/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC >XENP023379 20H4.9[4-1BB]_H0L0_Fab-1G6_L1.194_H1.279_scFv Fab-Fc Heavy Chain (SEQ ID NO: 29899)
QVQLQQWGAGLLKPSETLSLTCAVYGGSFSGYYWSWIRQSPEKGLEWIGEINHGGYVTYNPSLESRVTISVDTSKNQFS
LKLSSVTAADTAVYYCARDYGPGNYDWYFDLWGRGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPENNY
KTTPPVLDSDGSFFLYSKLTVDKSRWEQGDVFSCSVMHEALHNHYTQKSLSLSPGK >XENP023379 20H4.9[4-1BB]_H0L0_Fab-1G6_L1.194_H1.279_scFv scFv-Fc Heavy Chain (SEQ ID NO: 29900)
EIVLTQSPATLSASPGERVTLTCRASQSVGNDVAWYQQKPGQAPRLLINYASHRYTGVPDRFTGSGYGTEFTLTISSVQS
EDFGVYYCQQDFSSPRTFGGGTKVEIK/GKPGSGKPGSGKPGSGKPGS/EVQLVESGGGLVKPGGSLRLSCVASGFTFS
NYWMNWVRQAPGKGLEWVAEIRLYSNNYATHYAESVKGRFTISRDDSKSTLYLQMNNLKTEDTGVYYCTRYYGNYG
GYFDVWGRGTLVTVSS/EPKSSDKTHTCPPCPAPPVAGPSVFLFPPKPKDTLMISRTPEVTCVVVDVKHEDPEVKFNWY
VDGVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP023379 20H4.9[4-1BB]_H0L0_Fab-1G6_L1.194_H1.279_scFv Light Chain (SEQ ID NO: 29901)
EIVLTQSPATLSLSPGERATLSCRASQSVSSYLAWYQQKPGQAPRLLIYDASNRATGIPARFSGSGSGTDFTLTISSLEPED
FAVYYCQQRSNWPPALTFGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Additional CTLA-4 x ICOS Bispecific SEQ

>XENP019192 ipilimumab[CTLA-4]_H0L0_Fab-[anti-ICOS]-H0L0_scFv Fab-Fc Heavy Chain (SEQ ID NO: 29902)
QVQLVESGGGVVQPGRSLRLSCAASGFTFSSYTMHWVRQAPGKGLEWVTFISYDGNNKYYADSVKGRFTISRDNSKN
TLYLQMNSLRAEDTAIYYCARTGWLGPFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVA
GPSVFLFPPKPKDTLMISRTPEVTCVVVDVKHEDPEVKFNWYVDGVEVHNAKTKPREEEYNSTYRVVSVLTVLHQDWL
NGKEYKCKVSNKALPAPIEKTISKAKGQPREPQVYTLPPSREEMTKNQVSLTCDVSGFYPSDIAVEWESDGQPENNYKT
TPPVLDSDGSFFLYSKLTVDKSRWEQGDVFSCSVMHEALHNHYTQKSLSLSPGK

Figure 72C

>XENP019192 ipilimumab[CTLA-4]_H0L0_Fab-[anti-ICOS]-H0L0_scFv scFv-Fc Heavy Chain (SEQ ID NO: 29903)
QVQLVQSGAEVKKPGASVKVSCKASGYTFT<u>GYYMH</u>WVRQAPGQGLEWMG<u>WINPHSGGTNYAQKFQG</u>RVTMTRD
TSISTAYMELSRLRSDDTAVYYCAR<u>TYYYDSSGYYHDAFDI</u>WGQGTMVTVSS/<u>GKPGSGKPGSGKPGSGKPGS</u>/DIQMT
QSPSSVSASVGDRVTITC<u>RASQGISRLLA</u>WYQQKPGKAPKLLIY<u>VASSLQS</u>GVPSRFSGSGSGTDFTLTISSLQPEDFATYY
CQQANSFPWTFGQGTKVEIK/EPKSSDKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK >XENP019192 ipilimumab[CTLA-4]_H0L0_Fab-[anti-ICOS]-H0L0_scFv Light Chain (SEQ ID NO: 29904)
EIVLTQSPGTLSLSPGERATLSC<u>RASQSVGSSYLA</u>WYQQKPGQAPRLLIY<u>GAFSRAT</u>GIPDRFSGSGSGTDFTLTISRLEPE
DFAVYYC<u>QQYGSSPWT</u>FGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 73A

Prototype anti-4-1BB mAb

\>XENP014410 20H4.9[4-1BB]_H0L0_IgG1_PVA_/S267K Heavy Chain (SEQ ID NO: 29905)
QVQLQQWGAGLLKPSETLSLTCAVYGGSFS<u>GYYWS</u>WIRQSPEKGLEWIG<u>EINHGGYVTYNPSLESR</u>VTISVDTSKNQFS
LKLSSVTAADTAVYYCAR<u>DYGPGNYDWYFDL</u>WGRGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK \>XENP014410 20H4.9[4-1BB]_H0L0_IgG1_PVA_/S267K Light Chain (SEQ ID NO: 29906)
EIVLTQSPATLSLSPGERATLSC<u>RASQSVSSYLA</u>WYQQKPGQAPRLLIY<u>DASNRAT</u>GIPARFSGSGSGTDFTLTISSLEPED
FAVYYC<u>QQRSNWPPALT</u>FGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Prototype anti-OX40 mAb

\>XENP016437 11D4[OX40]_H0L0_IgG1_PVA_/S267K Heavy Chain (SEQ ID NO: 29907)
EVQLVESGGGLVQPGGSLRLSCAASGFTFS<u>SYSMN</u>WVRQAPGKGLEWVS<u>YISSSSSTIDYADSVK</u>GRFTISRDNAKNSL
YLQMNSLRDEDTAVYYCAR<u>ESGWYLFDY</u>WGQGTLVTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK \>XENP016437 11D4[OX40]_H0L0_IgG1_PVA_/S267K Light Chain (SEQ ID NO: 29908)
DIQMTQSPSSLSASVGDRVTITC<u>RASQGISSWLA</u>WYQQKPEKAPKSLIY<u>AASSLQS</u>GVPSRFSGSGSGTDFTLTISSLQPE
DFATYYC<u>QQYNSYPPT</u>FGGGTKVEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Prototype anti-GITR mAb

\>XENP016438 1D8[GITR]_H0L0_IgG1_PVA_/S267K Heavy Chain (SEQ ID NO: 29909)
QVTLKESGPGILKPSQTLSLTCSFSGFSLS<u>TSGMGVG</u>WIRQPSGKGLEWLA<u>HIWWDDDKYYSPSLK</u>SQLTISKDTSRNQ
VFLKITSLDTADTATYYCVR<u>SYYYGSSGAMDY</u>WGQGTSVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK

Figure 73B

>XENP016438 1D8[GITR]_H0L0_IgG1_PVA_/S267K Light Chain (SEQ ID NO: 29910)
DIVMTQTPLSLPVSLGDQASISCRSSQSLVHSDGNTYLHWYLQKPGQSPKLLIYKVSKRFSGVPDRFSGSGSGTDFTLKIS
RVEAEDLGVYFCSQSTHVPPTFGGGTKLEIK/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC

Prototype anti-ICOS mAbs

>XENP021820 GSK_314.8[ICOS]_H0L0_IgG1_PVA_/S267K Heavy Chain (SEQ ID NO: 29911)
QVQLQQPGTELMKPGASVKLSCKASGYTFTTYWMHWVKQRPGQGLEWIGEIDPSDSYVNYNQNFKGKATLTVDKSS
STAYIQLSSLTSEDSAVYFCARSPDYYGTSLAWFDYWGQGTLVTVST/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP021820 GSK_314.8[ICOS]_H0L0_IgG1_PVA_/S267K Light Chain (SEQ ID NO: 29912)
DIVMTQAAPSVPVTPGESVSISCRSSKSPLHSNGNIYLYWFLQRPGQSPQLLIYRMSNLASGVPDRFSGSGSGTTFTLKIS
RVEAEDVGVYYCMQHLEYPYTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC >XENP021821 GSK_88.2[ICOS]_H0L0_IgG1_PVA_/S267K Heavy Chain (SEQ ID NO: 29913)
QVQLQQPGAELVRPGASVKLSCKASGYSFTSYWINWVKQRPGQGLEWIGNIYPSDSYTNYNQMFKDKATLTVDKSSN
TAYMQLTSPTSEDSAVYYCTRWNLSYYFDNNYYLDYWGQGTTLVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK >XENP021821 GSK_88.2[ICOS]_H0L0_IgG1_PVA_/S267K Light Chain (SEQ ID NO: 29914)
DIVMTQAAPSVPVTPGESVSISCRSSKSLLHSNGNTYLYWFLQRPGQSPQLLIYRMSNLASGVPDRFSGSGSGTAFTLRIS
RVEAEDVGVYYCMQHLEYPWTFGGGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP021822 jMab-138[ICOS]_H0L0_IgG1_PVA_/S267K Heavy Chain (SEQ ID NO: 29915)
EVQLVESGGGLVQPGGSLRLSCAASGFTFSSYDMHWVRQATGKGLEWVSAIGTAGDTYYPGSVKGRFTISRENAKNSL
YLQMNSLRAGDTAVYYCVRDNRKVTHEHYYYGMDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGK

Figure 73C

>XENP021822 jMab-138[ICOS]_H0L0_IgG1_PVA_/S267K Light Chain (SEQ ID NO: 29916)
EIVLTQSPGTLSLSPGERATLSCRASQNIRSSYLAWYQQKPGQAPGLLIYGASSRATGIPDRFSGSGSGTDFTLTISRLEPE
DFAVYYCQQFGSSPMCSFGQGTKLEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP021823 jMab-139[ICOS]_H0L0_IgG1_PVA_/S267K Heavy Chain (SEQ ID NO: 29917)
EVQLVESGGGLVQPGGSLRLSCAASGFTFSSYDMHWVRQATGKGLEWVSAIGTAGDTYYPGSVKGRFTISRENAKNSL
YLQMNSLRAGDTAVYYCVRDKRTVTHEHYYYGMDVWGQGTTVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK >XENP021823 jMab-139[ICOS]_H0L0_IgG1_PVA_/S267K Light Chain (SEQ ID NO: 29918)
EIVLTQSPGTLSLSPGERATLSCRASQSISSSSLAWYQQKPGQAPGLLIFGASSRATGIPDRFSGSGSGTDFTLTISRLEPED
FAVYYCQQFGSSPMCSFGQGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC >XENP022346 WO2016059602_GSK[ICOS]_H0L0_IgG1_PVA_/S267K Heavy Chain (SEQ ID NO: 29919)
QVQLVQSGAEVKKPGSSVKVSCKASGYTFTDYAMHWVRQAPGQGLEWMGLISIYSDHTNYNQKFQGRVTITADKST
STAYMELSSLRSEDTAVYYCGRNNYGNYGWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPPVAGPSVFLFPPKPKDTLMISRTPEVTCVVVDVKHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP022346 WO2016059602_GSK[ICOS]_H0L0_IgG1_PVA_/S267K Light Chain (SEQ ID NO: 29920)
EIVLTQSPATLSLSPGERATLSCSASSSVSYMHWYQQKPGQAPRLLIYDTSKLASGIPARFSGSGSGTDYTLTISSLEPEDF
AVYYCFQGSGYPYTFGQGTKLEIK/RTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC >XENP023057 Jounce_37A10S713[ICOS]_H0L0_IgG1_PVA_/S267K Heavy Chain (SEQ ID NO: 29921)
EVQLVESGGGLVQPGGSLRLSCAASGFTFSDYWMDWVRQAPGKGLVWVSNIDEDGSITEYSPFVKGRFTISRDNAKN
TLYLQMNSLRAEDTAVYYCTRWGRFGFDSWGQGTTVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPVA
GPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREEMTKNQVSLTCLVKGFYPSDIAVEWESNGQPENNYKTT
PPVLDSDGSFFLYSKLTVDKSRWQQGNVFSCSVMHEALHNHYTQKSLSLSPGK

Figure 73D

\>XENP023057 Jounce_37A10S713[ICOS]_H0L0_IgG1_PVA_/S267K Light Chain (SEQ ID NO: 29922)
DIVMTQSPDSLAVSLGERATINC<u>KSSQSLLSGSFNYLT</u>WYQQKPGQPPKLLIF<u>YASTRHT</u>GVPDRFSGSGSGTDFTLTISS
LQAEDVAVYYC<u>HHHYNAPPT</u>FGPGTKVDIK/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC

Prototype anti-PD-L1 mAbs

\>XENP016434 YW243.55.S70[PD-L1]_H0L0_IgG1_PVA_/S267K Heavy Chain (SEQ ID NO: 29923)
EVQLVESGGGLVQPGGSLRLSCAASGFTFS<u>DSWIH</u>WVRQAPGKGLEWVA<u>WISPYGGSTYYADSVKG</u>RFTISADTSKNT
AYLQMNSLRAEDTAVYYCARR<u>HWPGGFDY</u>WGQGTLVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK \>XENP016434 YW243.55.S70[PD-L1]_H0L0_IgG1_PVA_/S267K Light Chain (SEQ ID NO: 29924)
DIQMTQSPSSLSASVGDRVTITC<u>RASQDVSTAVA</u>WYQQKPGKAPKLLIY<u>SASFLYS</u>GVPSRFSGSGSGTDFTLTISSLQPE
DFATYYC<u>QQYLYHPAT</u>FGQGTKVEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC \>XENP024118 avelumab[PD-L1]_H1L1_IgG1_PVA_/S267K Heavy Chain (SEQ ID NO: 29925)
EVQLLESGGGLVQPGGSLRLSCAASGFTFS<u>SYIMM</u>WVRQAPGKGLEWVS<u>SIYPSGGITFYADTVKG</u>RFTISRDNSKNTL
YLQMNSLRAEDTAVYYCAR<u>IKLGTVTTVDY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPVA
GPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREEMTKNQVSLTCLVKGFYPSDIAVEWESNGQPENNYKTT
PPVLDSDGSFFLYSKLTVDKSRWQQGNVFSCSVMHEALHNHYTQKSLSLSPGK \>XENP024118 avelumab[PD-L1]_H1L1_IgG1_PVA_/S267K Light Chain (SEQ ID NO: 29926)
QSALTQPASVSGSPGQSITISC<u>TGTSSDVGGYNYVS</u>WYQQHPGKAPKLMIY<u>DVSNRPS</u>GVSNRFSGSKSGNTASLTISG
LQAEDEADYYC<u>SSYTSSSTRV</u>FGTGTKVTVL/GQPKAAPSVTLFPPSSEELQANKATLVCLISDFYPGAVTVAWKADSSPV
KAGVETTTPSKQSNNKYAASSYLSLTPEQWKSHRSYSCQVTHEGSTVEKTVAPTECS \>XENP024119 durvalumab[PD-L1]_H1L1_IgG1_PVA_/S267K Heavy Chain (SEQ ID NO: 29927)
EVQLVESGGGLVQPGGSLRLSCAASGFTFS<u>RYWMS</u>WVRQAPGKGLEWVA<u>NIKQDGSEKYYVDSVKG</u>RFTISRDNAK
NSLYLQMNSLRAEDTAVYYCAR<u>EGGWFGELAFDY</u>WGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

Figure 73E

\>XENP024119 durvalumab[PD-L1]_H1L1_IgG1_PVA_/S267K Light Chain (SEQ ID NO: 29928)
EIVLTQSPGTLSLSPGERATLSC<u>RASQRVSSSYLA</u>WYQQKPGQAPRLLIY<u>DASSRAT</u>GIPDRFSGSGSGTDFTLTISRLEPE
DFAVYYC<u>QQYGSLPWT</u>FGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Prototype anti-PD-1 mAbs

\>XENP024120 LOPD180[PD-1]_H1L1_IgG1_PVA_/S267K Heavy Chain (SEQ ID NO: 29929)
QVQLQESGPGLVKPSQTLSLTCTVSGGSIS<u>SGAYYWS</u>WIRQHPGKGLEWIG<u>YIYYNGNTYYNPSLRS</u>RVTISVDTSKNQF
SLKLSSVTAADTAVYYCVR<u>ASDYVWGGYHYFDAFDL</u>WGRGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK \>XENP024120 LOPD180[PD-1]_H1L1_IgG1_PVA_/S267K Light Chain (SEQ ID NO: 29930)
QSVLTQPPSASGTPGQRVTISC<u>SGSNSNIGSNSVN</u>WYQQLPGTAPKLLIY<u>GNNQRPS</u>GVPDRFSGSKSGTSASLAISGL
QSEDEADYYC<u>AAWDDSLNGPV</u>FGGGTKVTVL/GQPKAAPSVTLFPPSSEELQANKATLVCLISDFYPGAVTVAWKADS
SPVKAGVETTTPSKQSNNKYAASSYLSLTPEQWKSHRSYSCQVTHEGSTVEKTVAPTECS \>XENP024121 mAb7(1.2)[PD-1]_H1L1_IgG1_PVA_/S267K Heavy Chain (SEQ ID NO: 29931)
QVQLVQSGAEVKKPGASVKVSCKASGYSFT<u>SYWMN</u>WVRQAPGQGLEWIG<u>VIHPSDSETWLDQKFKD</u>RVTITVDKST
STAYMELSSLRSEDTAVYYCAR<u>EHYGTSPFAY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK \>XENP024121 mAb7(1.2)[PD-1]_H1L1_IgG1_PVA_/S267K Light Chain (SEQ ID NO: 29932)
EIVLTQSPATLSLSPGERATLSC<u>RASESVDNYGMSFMN</u>WFQQKPGQPPKLLIH<u>AASNQGS</u>GVPSRFSGSGSGTDFTLTIS
SLEPEDFAVYFC<u>QQSKEVPYT</u>FGGGTKVEIK/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC

Figure 73F

Additional ICOS x PD-L1

>XENP021832 GSK_314.8[ICOS]_H0L0_Fab-YW243.55.S70[PD-L1]_H0L0_scFv Fab-Fc Heavy Chain (SEQ ID NO: 29933)
QVQLQQPGTELMKPGASVKLSCKASGYTFT<u>TYWMH</u>WVKQRPGQGLEWIG<u>EIDPSDSYVNYNQNFKG</u>KATLTVDKSSTAYIQLSS
LTSEDSAVYFCAR<u>SPDYYGTSLAWFDY</u>WGQGTLVTVST/ASTKGPSVFPLAPSSKSTSGGTAALGCLVKDYFPEPVTVSWNSGALTS
GVHTFPAVLQSSGLYSLSSVVTVPSSSLGTQTYICNVNHKPSDTKVDKKVEPKSCDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWEQGDVFSCSV
MHEALHNHYTQKSLSLSPGK >XENP021832 GSK_314.8[ICOS]_H0L0_Fab-YW243.55.S70[PD-L1]_H0L0_scFv scFv-Fc Heavy Chain (SEQ ID NO: 29934)
EVQLVESGGGLVQPGGSLRLSCAASGFTFS<u>DSWIH</u>WVRQAPGKGLEWVA<u>WISPYGGSTYYADSVKG</u>RFTISADTSKNTAYLQMNS
LRAEDTAVYYCAR<u>RHWPGGFDY</u>WGQGTLVTVSS/<u>GGGGSGGGGSGGGGS</u>/DIQMTQSPSSLSASVGDRVTITC<u>RASQDVSTAVA</u>
<u>WYQQKPGKAPKLLIY</u><u>SASFLYS</u>GVPSRFSGSGSGTDFTLTISSLQPEDFATYYC<u>QQYLYHPAT</u>FGQGTKVEIK/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK >XENP021832 GSK_314.8[ICOS]_H0L0_Fab-YW243.55.S70[PD-L1]_H0L0_scFv Light Chain (SEQ ID NO: 29935)
DIVMTQAAPSVPVTPGESVSISC<u>RSSKSPLHSNGNIYLY</u>WFLQRPGQSPQLLIY<u>RMSNLAS</u>GVPDRFSGSGSGTTFTLKISRVEAEDVG
VYYC<u>MQHLEYPYT</u>FGGGTKLEIK/RTVAAPSVFIFPPSDEQLKSGTASVVCLLNNFYPREAKVQWKVDNALQSGNSQESVTEQDSKD
STYSLSSTLTLSKADYEKHKVYACEVTHQGLSSPVTKSFNRGEC >XENP021833 GSK_88.2[ICOS]_H0L0_Fab-YW243.55.S70[PD-L1]_H0L0_scFv Fab-Fc Heavy Chain (SEQ ID NO: 29936)
QVQLQQPGAELVRPGASVKLSCKASGYSFT<u>SYWIN</u>WVKQRPGQGLEWIG<u>NIYPSDSYTNYNQMFKD</u>KATLTVDKSSNTAYMQLTS
PTSEDSAVYYCTR<u>WNLSYYFDNNYYLDY</u>WGQGTTLVTVSS/ASTKGPSVFPLAPSSKSTSGGTAALGCLVKDYFPEPVTVSWNSGALT
SGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALPAPIEKTISKAK
GQPREPQVYTLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >XENP021833 GSK_88.2[ICOS]_H0L0_Fab-YW243.55.S70[PD-L1]_H0L0_scFv scFv-Fc Heavy Chain (SEQ ID NO: 29937)
EVQLVESGGGLVQPGGSLRLSCAASGFTFS<u>DSWIH</u>WVRQAPGKGLEWVA<u>WISPYGGSTYYADSVKG</u>RFTISADTSKNTAYLQMNS
LRAEDTAVYYCAR<u>RHWPGGFDY</u>WGQGTLVTVSS/<u>GGGGSGGGGSGGGGS</u>/DIQMTQSPSSLSASVGDRVTITC<u>RASQDVSTAVA</u>
<u>WYQQKPGKAPKLLIY</u><u>SASFLYS</u>GVPSRFSGSGSGTDFTLTISSLQPEDFATYYC<u>QQYLYHPAT</u>FGQGTKVEIK/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Figure 73G

>XENP021833 GSK_88.2[ICOS]_H0L0_Fab-YW243.55.S70[PD-L1]_H0L0_scFv Light Chain (SEQ ID NO: 29938)
DIVMTQAAPSVPVTPGESVSISC<u>RSSKSLLHSNGNTYLY</u>WFLQRPGQSPQLLIY<u>RMSNLAS</u>GVPDRFSGSGSGTAFTLRIS
RVEAEDVGVYYC<u>MQHLEYPWT</u>FGGGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP021834 jMab-138[ICOS]_H0L0_Fab-YW243.55.S70[PD-L1]_H0L0_scFv Fab-Fc Heavy Chain (SEQ ID NO: 29939)
EVQLVESGGGLVQPGGSLRLSCAASGFTFS<u>SYDMH</u>WVRQATGKGLEWVS<u>AIGTAGDTYYPGSVKG</u>RFTISRENAKNSL
YLQMNSLRAGDTAVYYCVR<u>DNRKVTHEHYYYGMDV</u>WGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK >XENP021834 jMab-138[ICOS]_H0L0_Fab-YW243.55.S70[PD-L1]_H0L0_scFv scFv-Fc Heavy Chain (SEQ ID NO: 29940)
EVQLVESGGGLVQPGGSLRLSCAASGFTFS<u>DSWIH</u>WVRQAPGKGLEWVA<u>WISPYGGSTYYADSVKG</u>RFTISADTSKNT
AYLQMNSLRAEDTAVYYCARR<u>HWPGGFDY</u>WGQGTLVTVSS/<u>GGGGSGGGGSGGGGS</u>/DIQMTQSPSSLSASVGDR
VTITC<u>RASQDVSTAVA</u>WYQQKPGKAPKLLIY<u>SASFLYS</u>GVPSRFSGSGSGTDFTLTISSLQPEDFATYYC<u>QQYLYHPAT</u>FG
QGTKVEIK/EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSREQMTKNQVKL
TCLVKGFYPSDIAVEWESNGQPENNYKTTPPVLDSDGSFFLYSKLTVDKSRWQQGNVFSCSVMHEALHNHYTQKSLSL
SPGK >XENP021834 jMab-138[ICOS]_H0L0_Fab-YW243.55.S70[PD-L1]_H0L0_scFv Light Chain (SEQ ID NO: 29941)
EIVLTQSPGTLSLSPGERATLSC<u>RASQNIRSSYLA</u>WYQQKPGQAPGLLIY<u>GASSRAT</u>GIPDRFSGSGSGTDFTLTISRLEPE
DFAVYYC<u>QQFGSSPMCS</u>FGQGTKLEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP021835 jMab-139[ICOS]_H0L0_Fab-YW243.55.S70[PD-L1]_H0L0_scFv Fab-Fc Heavy Chain (SEQ ID NO: 29942)
EVQLVESGGGLVQPGGSLRLSCAASGFTFS<u>SYDMH</u>WVRQATGKGLEWVS<u>AIGTAGDTYYPGSVKG</u>RFTISRENAKNSL
YLQMNSLRAGDTAVYYCVR<u>DKRTVTHEHYYYGMDV</u>WGQGTTVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Figure 73H

>XENP021835 jMab-139[ICOS]_H0L0_Fab-YW243.55.S70[PD-L1]_H0L0_scFv scFv-Fc Heavy Chain (SEQ ID NO: 29943)
EVQLVESGGGLVQPGGSLRLSCAASGFTFSDSWIHWVRQAPGKGLEWVAWISPYGGSTYYADSVKGRFTISADTSKNT
AYLQMNSLRAEDTAVYYCARRHWPGGFDYWGQGTLVTVSS/GGGGSGGGGSGGGGS/DIQMTQSPSSLSASVGDR
VTITCRASQDVSTAVAWYQQKPGKAPKLLIYSASFLYSGVPSRFSGSGSGTDFTLTISSLQPEDFATYYCQQYLYHPATFG
QGTKVEIK/EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSREQMTKNQVKL
TCLVKGFYPSDIAVEWESNGQPENNYKTTPPVLDSDGSFFLYSKLTVDKSRWQQGNVFSCSVMHEALHNHYTQKSLSL
SPGK >XENP021835 jMab-139[ICOS]_H0L0_Fab-YW243.55.S70[PD-L1]_H0L0_scFv Light Chain (SEQ ID NO: 29944)
EIVLTQSPGTLSLSPGERATLSCRASQSISSSSLAWYQQKPGQAPGLLIFGASSRATGIPDRFSGSGSGTDFTLTISRLEPED
FAVYYCQQFGSSPMCSFGQGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC >XENP021836 jMab-136[ICOS]_H0L0_Fab-YW243.55.S70[PD-L1]_H0L0_scFv Fab-Fc Heavy Chain (SEQ ID NO: 29945)
QVQLVQSGAEVKKPGASVKVSCKASGYTFTGYYMHWVRQAPGQGLEWMGWINPHSGGTNYAQKFQGRVTMTRD
TSISTAYMELSRLRSDDTAVYYCARTYYYDSSGYYHDAFDIWGQGTMVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP021836 jMab-136[ICOS]_H0L0_Fab-YW243.55.S70[PD-L1]_H0L0_scFv scFv-Fc Heavy Chain (SEQ ID NO: 29946)
EVQLVESGGGLVQPGGSLRLSCAASGFTFSDSWIHWVRQAPGKGLEWVAWISPYGGSTYYADSVKGRFTISADTSKNT
AYLQMNSLRAEDTAVYYCARRHWPGGFDYWGQGTLVTVSS/GGGGSGGGGSGGGGS/DIQMTQSPSSLSASVGDR
VTITCRASQDVSTAVAWYQQKPGKAPKLLIYSASFLYSGVPSRFSGSGSGTDFTLTISSLQPEDFATYYCQQYLYHPATFG
QGTKVEIK/EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSREQMTKNQVKL
TCLVKGFYPSDIAVEWESNGQPENNYKTTPPVLDSDGSFFLYSKLTVDKSRWQQGNVFSCSVMHEALHNHYTQKSLSL
SPGK >XENP021836 jMab-136[ICOS]_H0L0_Fab-YW243.55.S70[PD-L1]_H0L0_scFv Light Chain (SEQ ID NO: 29947)
DIQMTQSPSSVSASVGDRVTITCRASQGISRLLAWYQQKPGKAPKLLIYVASSLQSGVPSRFSGSGSGTDFTLTISSLQPE
DFATYYCQQANSFPWTFGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 74A

Anti-PD-1-Fab x Anti-ICOS-scFv Bottle-openers

>XENP018920 nivolumab[PD-1]_H0L0_Fab-[anti-ICOS]_H0L0_scFv Fab-Fc Heavy Chain
(SEQ ID NO: 29948)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK >XENP018920 nivolumab[PD-1]_H0L0_Fab-[anti-ICOS]_H0L0_scFv scFv-Fc Heavy
Chain (SEQ ID NO: 29949)
QVQLVESGGGVVQPGRSLRLSCKASGITFSNSGMHWVRQAPGKGLEWVAVIWYDGSKRYYADSVKGRFTISRDNSKN
TLFLQMNSLRAEDTAVYYCATNDDYWGQGTLVTVSS/GKPGSGKPGSGKPGSGKPGS/EIVLTQSPATLSLSPGERA
TLSCRASQSVSSYLAWYQQKPGQAPRLLIYDASNRATGIPARFSGSGSGTDFTLTISSLEPEDFAVYYCQQSSNWPR
TFGQGTKVEIK/EPKSSDKTHTCPPCPAPPVAGPSVFLFPPKPKDTLMISRTPEVTCVVVDVKHEDPEVKFNWYVDG
VEVHNAKTKPREEQYNSTYRVVSVLTVLHQDWLNGKEYKCKVSNKALPAPIEKTISKAKGQPREPQVYTLPPSREQM
TKNQVKLTCLVKGFYPSDIAVEWESNGQPENNYKTTPPVLDSDGSFFLYSKLTVDKSRWQQGNVFSCSVMHEALHNH
YTQKSLSLSPGK >XENP018920 nivolumab[PD-1]_H0L0_Fab-[anti-ICOS]_H0L0_scFv Light Chain (SEQ
ID NO: 29950)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP024130 LOPD180[PD-1]_H1L1_Fab-[anti-ICOS]_H0L0_scFv Fab-Fc Heavy Chain
(SEQ ID NO: 29951)
QVQLQESGPGLVKPSQTLSLTCTVSGGSISSGAYYWSWIRQHPGKGLEWIGYIYYNGNTYYNPSLRSRVTISVDTSK
NQFSLKLSSVTAADTAVYYCVRASDYVWGGYHYFDAFDLWGRGTLVTVSS/ASTKGPSVFPLAPSSKSTSGGTAALG
CLVKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK >XENP024130 LOPD180[PD-1]_H1L1_Fab-[anti-ICOS]_H0L0_scFv scFv-Fc Heavy Chain
(SEQ ID NO: 29952)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGIYHDAFDIWGQGTMVTVSS/GKPGSGKPGSGKPGSGKPGS/DIQMTQS
PSSVSASVGDRVTITCRASQGISRLLAWYQQKPGKAPKLLIYAASSLQSGVPSRFSGSGSGTDFTLTISSLQPEDFA
TYYCQQANSFPWTFGQGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP024130 LOPD180[PD-1]_H1L1_Fab-[anti-ICOS]_H0L0_scFv Light Chain (SEQ ID
NO: 29953)
QSVLTQPPSASGTPGQRVTISCSGSNSNIGSNSVNWYQQLPGTAPKLLIYGNNQRPSGVPDRFSGSKSGTSASLAIS
GLQSEDEADYYCAAWDDSLNGPVFGGGTKVTVL/GQPKAAPSVTLFPPSSEELQANKATLVCLISDFYPGAVTVAWK
ADSSPVKAGVETTTPSKQSNNKYAASSYLSLTPEQWKSHRSYSCQVTHEGSTVEKTVAPTECS

Figure 74B

ICOS x PD-1 Bottle-openers with different ICOS ABDs

>XENP021828 GSK_314.8[ICOS]_H0L0_Fab-1G6_L1.194_H1.279_scFv Fab-Fc Heavy
Chain (SEQ ID NO: 29954)
QVQLQQPGTELMKPGASVKLSCKASGYTFTTYWMHWVKQRPGQGLEWIGEIDPSDSYVNYNQNFKGKATLTVDKSSS
TAYIQLSSLTSEDSAVYFCARSPDYYGTSLAWFDYWGQGTLVTVST/ASTKGPSVFPLAPSSKSTSGGTAALGCLVK
DYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYNSTYRV
VSVLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK >XENP021828 GSK_314.8[ICOS]_H0L0_Fab-1G6_L1.194_H1.279_scFv scFv-Fc Heavy
Chain (SEQ ID NO: 29955)
EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK >XENP021828 GSK_314.8[ICOS]_H0L0_Fab-1G6_L1.194_H1.279_scFv Light Chain (SEQ
ID NO: 29956)
DIVMTQAAPSVPVTPGESVSISCRSSKSPLHSNGNIYLYWFLQRPGQSPQLLIYRMSNLASGVPDRFSGSGSGTTFT
LKISRVEAEDVGVYYCMQHLEYPYTFGGGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP021829 GSK_88.2[ICOS]_H0L0_Fab-1G6_L1.194_H1.279_scFv Fab-Fc Heavy Chain
(SEQ ID NO: 29957)
QVQLQQPGAELVRPGASVKLSCKASGYSFTSYWINWVKQRPGQGLEWIGNIYPSDSYTNYNQMFKDKATLTVDKSSN
TAYMQLTSPTSEDSAVYYCTRWNLSYYFDNNYYLDYWGQGTTLTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK >XENP021829 GSK_88.2[ICOS]_H0L0_Fab-1G6_L1.194_H1.279_scFv scFv-Fc Heavy
Chain (SEQ ID NO: 29958)
EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK >XENP021829 GSK_88.2[ICOS]_H0L0_Fab-1G6_L1.194_H1.279_scFv Light Chain (SEQ
ID NO: 29959)
DIVMTQAAPSVPVTPGESVSISCRSSKSLLHSNGNTYLYWFLQRPGQSPQLLIYRMSNLASGVPDRFSGSGSGTAFT
LRISRVEAEDVGVYYCMQHLEYPWTFGGGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 74C

>XENP021830 jMab-138[ICOS]_H0L0_Fab-1G6_L1.194_H1.279_scFv Fab-Fc Heavy Chain (SEQ ID NO: 29960)
EVQLVESGGGLVQPGGSLRLSCAASGFTFSSYIMHWVRQATGKGLEWVSAIGTAGDTYYPGSVKGRFTISRENAKNSLYLQMNSLR
AGDTAVYYCVRDNRKVTHEHYYYGMDVWGQGTTVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSDTKVDKKVEPKSCDKTHTCPPCPAPPVAGPSVFLFPPKPKDT
LMISRTPEVTCVVVDVKHEDPEVKFNWYVDGVEVHNAKTKPREEEYNSTYRVVSVLTVLHQDWLNGKEYKCKVSNKALPAPIEKTI
SKAKGQPREPQVYTLPPSREEMTKNQVSLTCDVSGFYPSDIAVEWESDGQPENNYKTTPPVLDSDGSFFLYSKLTVDKSRWEQGDV
FSCSVMHEALHNHYTQKSLSLSPGK >XENP021830 jMab-138[ICOS]_H0L0_Fab-1G6_L1.194_H1.279_scFv scFv-Fc Heavy Chain (SEQ ID NO: 29961)
EIVLTQSPATLSASPGERVTLTCRASQSVGNDVAWYQQKPGQAPRLLINYASHRYTGVPDRFTGSGYGTEFTLTISSVQSEDFGVY
YCQQDFSSPRTFGGGTKVEIK/GKPGSGKPGSGKPGSGKPGS/EVQLVESGGGLVKPGGSLRLSCVASGFTFSNYWMNWVRQAPGK
GLEWVAEIRLYSNNYATHYAESVKGRFTISRDDSKSTLYLQMNNLRTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK >XENP021830 jMab-138[ICOS]_H0L0_Fab-1G6_L1.194_H1.279_scFv Light Chain (SEQ ID NO: 29962)
EIVLTQSPGTLSLSPGERATLSCRASQNIFSSYLAWYQQKPGQAPGLLIYGASSRATGIPDRFSGSGSGTDFTLTISRLEPEDFAV
YYCQQFGSSPMCSFGQGTKLEIK/RTVAAPSVFIFPPSDEQLKSGTASVVCLLNNFYPREAKVQWKVDNALQSGNSQESVTEQDSK
DSTYSLSSTLTLSKADYEKHKVYACEVTHQGLSSPVTKSFNRGEC >XENP021831 jMab-139[ICOS]_H0L0_Fab-1G6_L1.194_H1.279_scFv Fab-Fc Heavy Chain (SEQ ID NO: 29963)
EVQLVESGGGLVQPGGSLRLSCAASGFTFSSYDMHWVRQATGKGLEWVSAIGTAGDTYYPGSVKGRFTISRENAKNSLYLQMNSLR
AGDTAVYYCVRDKPTVTHEHYYYGMDVWGQGTTVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSDTKVDKKVEPKSCDKTHTCPPCPAPPVAGPSVFLFPPKPKDT
LMISRTPEVTCVVVDVKHEDPEVKFNWYVDGVEVHNAKTKPREEEYNSTYRVVSVLTVLHQDWLNGKEYKCKVSNKALPAPIEKTI
SKAKGQPREPQVYTLPPSREEMTKNQVSLTCDVSGFYPSDIAVEWESDGQPENNYKTTPPVLDSDGSFFLYSKLTVDKSRWEQGDV
FSCSVMHEALHNHYTQKSLSLSPGK >XENP021831 jMab-139[ICOS]_H0L0_Fab-1G6_L1.194_H1.279_scFv scFv-Fc Heavy Chain (SEQ ID NO: 29964)
EIVLTQSPATLSASPGERVTLTCRASQSVGNDVAWYQQKPGQAPRLLINYASHRYTGVPDRFTGSGYGTEFTLTISSVQSEDFGVY
YCQQDFSSPRTFGGGTKVEIK/GKPGSGKPGSGKPGSGKPGS/EVQLVESGGGLVKPGGSLRLSCVASGFTFSNYWMNWVRQAPGK
GLEWVAEIRLYSNNYATHYAESVKGRFTISRDDSKSTLYLQMNNLRTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK >XENP021831 jMab-139[ICOS]_H0L0_Fab-1G6_L1.194_H1.279_scFv Light Chain (SEQ ID NO: 29965)
EIVLTQSPGTLSLSPGERATLSCRASQSISSSSLAWYQQKPGQAPGLLIFGASSRATGIPDRFSGSGSGTDFTLTISRLEPEDFAV
YYCQQFGSSPMCSFGQGTKLEIK/RTVAAPSVFIFPPSDEQLKSGTASVVCLLNNFYPREAKVQWKVDNALQSGNSQESVTEQDSK
DSTYSLSSTLTLSKADYEKHKVYACEVTHQGLSSPVTKSFNRGEC >XENP022348 WO2016059602_GSK_H0L0_Fab-1G6_L1.194_H1.279_scFv Fab-Fc Heavy Chain (SEQ ID NO: 29966)
QVQLVQSGAEVKKPGSSVKVSCKASGYTFTDYAMHWVRQAPGQGLEWMGLISIYSDHTRYNQKFQGRVTITADKSTSTAYMELSSL
RSEDTAVYYCGRNNYGNYGWYFDVWGQGTTVTVSS/ASTKGPSVFPLAPSSKSTSGGTAALGCLVKDYFPEPVTVSWNSGALTSGV
HTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALPAPIEKTISKAK
GQPREPQVYTLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

Figure 74D

>XENP022348 WO2016059602_GSK_H0L0_Fab-1G6_L1.194_H1.279_scFv scFv-Fc Heavy
Chain (SEQ ID NO: 29967)
EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK >XENP022348 WO2016059602_GSK_H0L0_Fab-1G6_L1.194_H1.279_scFv Light Chain (SEQ
ID NO: 29968)
EIVLTQSPATLSLSPGERATLSCSASSSVSYMHWYQQKPGQAPRLLIYDTSKLASGIPARFSGSGSGTDYTLTISSL
EPEDFAVYYCFQGSGYPYTFGQGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Anti-PD-L1 x anti-ICOS Antibodies

>XENP021748 YW243.55.S70[PD-L1]_H0L0_Fab-[anti-ICOS]_H0L0_scFv Fab-Fc Heavy
Chain (SEQ ID NO: 29969)
EVQLVESGGGLVQPGGSLRLSCAASGFTFSDSWIHWVRQAPGKGLEWVAWISPYGGSTYYADSVKGRFTISADTSKN
TAYLQMNSLRAEDTAVYYCARRHWPGGFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK >XENP021748 YW243.55.S70[PD-L1]_H0L0_Fab-[anti-ICOS]_H0L0_scFv scFv-Fc Heavy
Chain (SEQ ID NO: 29970)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/GKPGSGKPGSGKPGSGKPGS/DIQMTQS
PSSVSASVGDRVTITCRASQGISRLLAWYQQKPGKAPKLLIYAASSLQSGVPSRFSGSGSGTDFTLTISSLQPEDFA
TYYCQQANSFPWTFGQGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP021748 YW243.55.S70[PD-L1]_H0L0_Fab-[anti-ICOS]_H0L0_scFv Light Chain
(SEQ ID NO: 29971)
DIQMTQSPSSLSASVGDRVTITCRASQDVSTAVAWYQQKPGKAPKLLIYSASFLYSGVPSRFSGSGSGTDFTLTISS
LQPEDFATYYCQQYLYHPATFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Anti-ICOS x anti-CTLA-4 Bottle Opener

>XENP021749 [anti-ICOS]_H0L0_Fab-[anti-CTLA-4]_H3.23_L0.129_scFv Fab-Fc Heavy
Chain (SEQ ID NO: 29972)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

Figure 74E

>XENP021749 [anti-ICOS]_H0L0_Fab-[anti-CTLA-4]_H3.23_L0.129_scFv scFv-Fc Heavy Chain (SEQ ID NO: 29973)
EVQLVESGGGLVKPGGSLRLSCAASGFTFSSYTMHWVRQAPGKGLEWVSFISYDGNYKYYADSVKGRFTISRDNAKNSLYLQ
MNSLRAEDTAVYYCARGGHLGPFDLWGQGTMVTVSS/GKPGSGKPGSGKPGSGKPGS/EIVLTQSPATLSLSPGERATLSCR
ASQSVGSSYLAWYQQKPGQAPRLLIYGASSRATGIPDRFSGSGSGTDFTLTISRLEPEDFAVYYCQQYGSSPWTFGQGTKVE
IK/EPKSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK >XENP021749 [anti-ICOS]_H0L0_Fab-[anti-CTLA-4]_H3.23_L0.129_scFv Light Chain (SEQ ID NO: 29974)
DIQMTQSPSSVSASVGDRVTITCRASQGISRLLAWYQQKPGKAPKLLIYYASSLQSGVPSRFSGSGSGTDFTLTISSLQPED
FATYYCQQANSFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

ICOS one-arm from alternative ICOS ABDs

>XENP021861 GSK_314.8[ICOS]_H0L0 one-arm mAb Fab-Fc Heavy Chain (SEQ ID NO: 29975)
QVQLQQPGTELMKPGASVKLSCKASGYTFTTYWMHWVKQRPGQGLEWIGEIDPSDSYVNYNQNFKGKATLTVDKSSSTAYIQ
LSSLTSEDSAVYFCARSPDYYGTSLAWFDYWGQGTLVTVST/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK >XENP021861 GSK_314.8[ICOS]_H0L0 one-arm mAb Fc-only Heavy Chain (SEQ ID NO: 29976)
ERKSSDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK >XENP021861 GSK_314.8[ICOS]_H0L0 one-arm mAb Light Chain (SEQ ID NO: 29977)
DIVMTQAAPSVPVTPGESVSISCRSSKSFLHSNGNIYLYWFLQRPGQSPQLLIYRMSNLASGVPDRFSGSGSGTTFTLKISR
VEAEDVGVYYCMQHLEYPYTFGGGTKLEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP021863 jMab-138[ICOS]_H0L0 one-arm mAb Fab-Fc Heavy Chain (SEQ ID NO: 29978)
EVQLVESGGGLVQPGGSLRLSCAASGFTFSSYDMHWVRQATGKGLEWVSAIGTAGDTYYPGSVKGRFTISRENAKNSLYLQM
NSLRAGDTAVYYCVRDNRKVTHEHYYYGMDVWGQGTTVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK >XENP021863 jMab-138[ICOS]_H0L0 one-arm mAb Fc-only Heavy Chain (SEQ ID NO: 29979)
ERKSSDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK >XENP021863 jMab-138[ICOS]_H0L0 one-arm mAb Light Chain (SEQ ID NO: 29980)
EIVLTQSPGTLSLSPGERATLSCRASQNIRSSYLAWYQQKPGQAPGLLIYGASSRATGIPDRFSGSGSGTDFTLTISRLEPE
DFAVYYCQQFGSSPMCSFGQGTKLEIK/RTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 74F

>XENP022349 WO2016059602[ICOS]_GSK_H0L0 one-arm mAb Fab-Fc Heavy Chain (SEQ ID NO: 29981)
QVQLVQSGAEVKKPGSSVKVSCKASGYTFTDYAMHWVRQAPGQGLEWMGLISIYSDHTNYNQKFQGRVTITADKSTS
TAYMELSSLRSEDTAVYYCGRNNYGNYGNYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK >XENP022349 WO2016059602[ICOS]_GSK_H0L0 one-arm mAb Fc-only Heavy Chain (SEQ ID NO: 29982)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP022349 WO2016059602[ICOS]_GSK_H0L0 one-arm mAb Light Chain (SEQ ID NO: 29983)
EIVLTQSPATLSLSPGERATLSCSASSSVSYMHWYQQKPGQAPRLLIYDTSKLASGIPARFSGSGSGTDYTLTISSL
EPEDFAVYYCFQGSGYPYTFGQGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 75A mAb-scFv backbone 1 (356E/358M allotype)

monomer 1 (Fab-scFv side) (SEQ ID NO: 29984)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK monomer 2 (Fab side) (SEQ ID NO: 29985)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK constant light chain (SEQ ID NO: 29986)

RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 75B mAb-scFv backbone 2

Fab-scFv-Hc - 356D/358L allotype (SEQ ID NO: 29987)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>mAb-scFv Fab-Hc - 356D/358L allotype (SEQ ID NO: 29988)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSRDQLTKNQVKLTCLVKGFYPSDIAVEWESNGQPENNYKTTPPVLDSDGSFFLYSKLTVDKSRWQQGNVFSCS
VMHEALHNHYTQKSLSLSPGK mAb-scFv backbone 3

>mAb-scFv Fab-scFv-Hc - N297A (SEQ ID NO: 29989)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>mAb-scFv Fab-Hc - N297A (SEQ ID NO: 29990)

ASTKGPSVFPLAPSSKSTSGGTAALGCLVKDYFPEPVTVSWNSGALTSGVHTFPAVLQSSGLYSLSSVVTVPSSSLG
TQTYICNVNHRKPSDTKVDKKVEPKSSDKTHTCPPCPAPPVAGPSVFLFPPKPKDTLMISRTPEVTCVVVDVKHEDPE
VKFNWYVDGVEVHNAKTKPREEQYASTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Figure 75C mAb-scFv backbone 4

>mAb-scFv Fab-scFv-Hc - N297S (SEQ ID NO: 29991)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>mAb-scFv Fab-Hc - N297S (SEQ ID NO: 29992)

ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSSDKTHTCPPCPAPPVAGPSVFLFPPKPKDTLMISRTPEVTCVVVDVKHEDPE
VKFNWYVDGVEVHNAKTKPREEQYSSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK mAb-scFv backbone 5 mAb-scFv Fab-scFv-IgG4-Hc (SEQ ID NO: 29993)

ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPPCPAPEFLGGPSVFLFPPKPKDTLMISRTPEVTCVVVDVKQEDPEVQ
FNWYVDGVEVHNAKTKPREEEFNSTYRVVSVLTVLHQDWLNGKEYKCKVSNKGLPSSIEKTISKAKGQPREPQVYTL
PPSQEEMTKNQVSLTCDVSGFYPSDIAVEWESDGQPENNYKTTPPVLDSDGSFFLYSKLTVDKSRWEEGDVFSCSVM
HEALHNHYTQKSLSLSLGK

>mAb-scFv Fab-IgG4-Hc (SEQ ID NO: 29994)

ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPPCPAPEFLGGPSVFLFPPKPKDTLMISRTPEVTCVVVDVKQEDPEVQ
FNWYVDGVEVHNAKTKPREEQFNSTYRVVSVLTVLHQDWLNGKEYKCKVSNKGLPSSIEKTISKAKGQPREPQVYTL
PPSQEQMTKNQVKLTCLVKGFYPSDIAVEWESNGQPENNYKTTPPVLDSDGSFFLYSKLTVDKSRWQEGNVFSCSVM
HEALHNHYTQKSLSLSLGK

Figure 75D mAb-scFv backbone 6

>mAb-scFv Fab-scFv-IgG2-Hc - without S267K (SEQ ID NO: 29995)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVSHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK

>mAb-scFv Fab-IgG2-Hc - without S267K (SEQ ID NO: 29996)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCSVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQPREPQVYTLP
PSREQMTKNQVKLTCLVKGFYPSDIAVEWESNGQPENNYKTTPPMLDSDGSFFLYSKLTVDKSRWQQGNVFSCSVMH
EALHNHYTQKSLSLSPGK mAb-scFv backbone 7

>mAb-scFv Fab-scFv-IgG2-Hc - with S267K (SEQ ID NO: 29997)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVKHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK

>mAb-scFv Fab-IgG2-Hc - with S267K (SEQ ID NO: 29998)

ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCSVECPPCPAPPVAGPSVFLFPPKPKDTLMISRTPEVTCVVVDVKHEDPEVQF
NWYVDGVEVHNAKTKPREEQFNSTFRVVSVLTVVHQDWLNGKEYKCKVSNKGLPAPIEKTISKTKGQPREPQVYTLP
PSREQMTKNQVKLTCLVKGFYPSDIAVEWESNGQPENNYKTTPPMLDSDGSFFLYSKLTVDKSRWQQGNVFSCSVMH
EALHNHYTQKSLSLSPGK

Figure 76A additional anti-PD-1 sequences

Merck Pembrolizumab VH (SEQ ID NO: 29999)

QVQLVQSGVEVKKPGASVKVSCKASGYTFTNYYMYWVRQAPGQGLEWMGGINPSNGGTNFNEKFKNRVTLTTDSST
TTAYMELKSLQFDDTAVYYCARRDYRFDMGFDYWGQGTTVTVSS

Merck Pembrolizumab VL (SEQ ID NO: 30000)

EIVLTQSPATLSLSPGERATLSCRASKGVSTSGYSYLHWYQQKPGQAPRLLIYLASYLESGVPARFSGSGSGTDFTLTISS
LEPEDFAVYYCQHSRDLPLTFGGGTKVEIK

BMS nivolumab VH (SEQ ID NO: 30001)

QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS

BMS nivolumab VL (SEQ ID NO: 30002)

EIVLTQSPATLSLSPGERATLSCRASQSVSSYLAWYQQKPGQAPRLLIYDASNRATGIPARFSGSGSGTDFTLTISSLEPED
FAVYYCQQSSNWPRTFGQGTKVEIK

Teva pidilizumab VH (SEQ ID NO: 30003)

QVQLVQSGSELKKPGASVKISCKASGYTFTNYGMNWVRQAPGQGLQWMGWINTDSGESTYAEEFKGRFVFSLDTSVN
TAYLQITSLTAEDTGMYFCVRVGYDALDYWGQGTLVTVSS

Teva pidilizumab VL (SEQ ID NO: 30004)

EIVLTQSPSSLSASVGDRVTITCSARSSVSYMHWFQQKPGKAPKLWIYRTSNLASGVPSRFSGSGSGTSYCLTINSLQPED
FATYYCQQRSSFPLTFGGGTKLEIK

Pfizer MK-3475 VH (SEQ ID NO: 30005)

QVQLVQSGVEVKKPGASVKVSCKASGYTFTNYYMYWVRQAPGQGLEWMGGINPSNGGTNFNEKFKNRVTLTTDSST
TTAYMELKSLQFDDTAVYYCARRDYRFDMGFDYWGQGTTVTVSS

Pfizer MK-3475 VL (SEQ ID NO: 30006)

EIVLTQSPATLSLSPGERATLSCRASKGVSTSGYSYLHWYQQKPGQAPRLLIYLASYLESGVPARFSGSGSGTDFTLTISS
LEPEDFAVYYCQHSRDLPLTFGGGTKVEIK

Novartis/Dana Farber BAP049 clone E VH (SEQ ID NO: 30007)

EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS

Novartis/Dana Farber BAP049 clone E VL (SEQ ID NO: 30008)

EIVLTQSPATLSLSPGERATLSCKSSQSLLDSGNQKNFLTWYQQKPGQAPRLLIYWASTRESGVPSRFSGSGSGTDFTFTI
SSLEAEDAATYYCQNDYSYPYTFGQGTKVEIK

Novartis/Dana Farber BAP049 clone B VH (SEQ ID NO: 30009)

EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS

Novartis/Dana Farber BAP049 clone B VL (SEQ ID NO: 30010)

EIVLTQSPATLSLSPGERATLSCKSSQSLLDSGNQKNFLTWYQQKPGKAPKLLIYWASTRESGVPSRFSGSGSGTDFTFTI
SSLQPEDIATYYCQNDYSYPYTFGQGTKVEIK

Figure 76B

Regeneron H7798N VH (SEQ ID NO: 30011)

EVQLLESGGVLVQPGGSLRLSCAASGFTFSNFGMTWVRQAPGKGLEWVSGISGGGRDTYFADSVKGRFTISRDNSKNT
LYLQMNSLKGEDTAVYYCVKWGNIYFDYWGQGTLVTVSS

Regeneron H7798N VH (SEQ ID NO: 30012)

DIQMTQSPSSLSASVGDSITITCRASLSINTFLNWYQQKPGKAPNLLIYAASSLHGGVPSRFSGSGSGTDFTLTIRTLQPED
FATYYCQQSSNTPFTFGPGTVVDFR

Medimmune h1H3 Var 6 VH (SEQ ID NO: 30013)

EVQLVESGGGLVQPGGSLRLSCAASGFTFSDYGMHWVRQAPGKGLEWVAYISSGSYTIYYADSVKGRFTISRDNAKNT
LYLQMSSLRAEDTAVYYCARRGYGSFYEYYFDYWGQGTTVTVSS

Medimmune h1H3 Var 6 VL (SEQ ID NO: 30014)

QIVLTQSPATLSLSPGERATLSCSASSSVSYMYWYQQKPGQAPRLLIYLTSNRATGIPARFSGSGSGTDYTLTISSLEPEDF
AVYYCQQWSSNPFTFGQGTKLEIK

Tesarao TSR-042/APE2058 VH (SEQ ID NO: 30015)

EVQLLESGGGLVQPGGSLRLSCAASGFTFSSYDMSWVRQAPGKGLEWVSTISGGGSYTYYQDSVKGRFTISRDNSKNTL
YLQMNSLRAEDTAVYYCASPYYAMDYWGQGTTVTVSS

Tesarao TSR-042/APE2058 VL (SEQ ID NO: 30016)

DIQLTQSPSFLSAYVGDRVTITCKASQDVGTAVAWYQQKPGKAPKLLIYWASTLHTGVPSRFSGSGSGTEFTLTISSLQP
EDFATYYCQHYSSYPWTFGQGTKLEIK

Incyte Camrelizumab VH (SEQ ID NO: 30017)

EVQLVESGGGLVQPGGSLRLSCAASGFTFSSYMMSWVRQAPGKGLEWVATISGGGANTYYPDSVKGRFTISRDNAKNS
LYLQMNSLRAEDTAVYYCARQLYYFDYWGQGTTVTVSS

Incyte Camrelizumab VL (SEQ ID NO: 30018)

DIQMTQSPSSLSASVGDRVTITCLASQTIGTWLTWYQQKPGKAPKLLIYTATSLADGVPSRFSGSGSGTDFTLTISSLQPE
DFATYYCQQVYSIPWTFGGGTKVEIK

Beigene 317-4B6 VH (SEQ ID NO: 30019)

QVQLQESGPGLVKPSETLSLTCTVSGFSLTSYGVHWIRQPPGKGLEWIGVIYADGSTNYNPSLKSRVTISKDTSKNQVSL
KLSSVTAADTAVYYCARAYGNYWYIDVWGQGTTVTVSS

Beigene 317-4B6 VL (SEQ ID NO: 30020)

DIVMTQSPDSLAVSLGERATINCKSSESVSNDVAWYQQKPGQPPKLLINYAFHRFTGVPDRFSGSGYGTDFTLTISSLQA
EDVAVYYCHQAYSSPYTFGQGTKLEIK

Beigene 326-4A3 VH (SEQ ID NO: 30021)

QVQLVQSGSELKKPGASVKVSCKASGYTFTNYGMNWVRQAPGQGLKWMGWINNNNAEPTYAQDFRGRFVFSLDTSA
STAYLQISSLKTEDTAVYYCARDVMDYWGQGTLVTVSS

Beigene 326-4A3 VL (SEQ ID NO: 30022)

DIVLTQSPASLAVSPGQRATITCRASESVDNYGYSFMHWYQQKPGQPPKLLIYRASNLESGVPARFSGSGSGTDFTLTIN
PVEAEDTANYYCQQSKEYPTFGGGTKVEIK

Figure 76C

Macrogenics mAb 7 (1.2) VH (SEQ ID NO: 30023)

QVQLVQSGAEVKKPGASVKVSCKASGYSFTSYWMNWVRQAPGQGLEWIGVIHPSDSETWLDQKFKDRVTITVDKSTS
TAYMELSSLRSEDTAVYYCAREHYGTSPFAYWGQGTLVTVSS

Macrogenics mAb 7 (1.2) VL (SEQ ID NO: 30024)

EIVLTQSPATLSLSPGERATLSCRASESVDNYGMSFMNWFQQKPGQPPKLLIHAASNQGSGVPSRFSGSGSGTDFTLTISS
LEPEDFAVYFCQQSKEVPYTFGGGTKVEIK

Junmeng Clone 38 VH (SEQ ID NO: 30025)

QGQLVQSGAEVKKPGASVKVSCKASGYTFTDYEMHWVRQAPIHGLEWIGVIESETGGTAYNQKFKGRVTITADKSTST
AYMELSSLRSEDTAVYYCAREGITTVATTYYWYFDVWGQGTTVTVSS

Junmeng Clone 38 VL (SEQ ID NO: 30026)

DVVMTQSPLSLPVTLGQPASISCRSSQSIVHSNGNTYLEWYLQKPGQSPQLLIYKVSNRFSGVPDRFSGSGSGTDFTLKIS
RVEAEDVGVYYCFQGSHVPLTFGQGTKLEIK

Junmeng Clone 39 VH (SEQ ID NO: 30027)

QGQLVQSGAEVKKPGASVKVSCKASGYTFTDYEMHWVRQAPGQGLEWMGVIESETGGTAYNQKFKGRAKITADKST
STAYMELSSLRSEDTAVYYCTREGITTVATTYYWYFDVWGQGTTVTVSS

Junmeng Clone 39 VL (SEQ ID NO: 30028)

DVVMTQSPLSLPVTLGQPASISCRSSQSIVHSNGNTYLEWYLQKPGQSPQLLIYKVSNRFSGVPDRFSGSGSGTDFTLKIS
RVEAEDVGVYYCFQGSHVPLTFGQGTKLEIK

Junmeng Clone 41 VH (SEQ ID NO: 30029)

QGQLVQSGAEVKKPGASVKVSCKASGYTFTDYEMHWVRQAPGQGLEWMGVIESETGGTAYNQKFQGRVTLTADKSS
STAYMELSSLRSEDTAVYYCTREGITTVATTYYWYFDVWGQGTLVTVSS

Junmeng Clone 41 VL (SEQ ID NO: 30030)

DVVMTQSPLSLPVTLGQPASISCRSSQSIVHSNGNTYLEWYLQKPGQSPQLLIYKVSNRFSGVPDRFSGSGSGTDFTLKIS
RVEAEDVGVYYCFQGSHVPLTFGQGTKLEIK

Junmeng Clone 48 VH (SEQ ID NO: 30031)

QGQLVQSGAEVKKPGASVKVSCKASGYTFTDYEMHWVRQAPGQGLEWMGVIESETGGTAYNQKFKGRAKITADKST
STAYMELSSLRSEDTAVYYCTREGITTVATTYYWYFDVWGQGTTVTVSS

Junmeng Clone 48 VL (SEQ ID NO: 30032)

DVVMTQSPLSLPVTLGQPASISCRSSQSIVHSNGNTYLEWYLQKPGQSPRLLIYKVSNRFSGVPDRFSGSGSGTDFTLKIS
RVEAEDVGVYYCFQGSHVPLTFGQGTKLEIK

Wyeth PD1-17 VH (SEQ ID NO: 30033)

QVQLQESGPGVVKPSGTLSLTCAISGGSIGSGGSIRSTRWWSWVRQSPGKGLEWIGEIYHSGSTNYNPSLKSRVTISLDKS
RNHFSLRLNSVTAADTAVYYCARQDYGDSGDWYFDLWGKGTMVTVSS

Wyeth PD1-17 VL (SEQ ID NO: 30034)

NFMLTQPHSVSESPGKTVTISCTRSSGSIASNSVQWYQQRPGSSPTTVIYEDNQRPSGVPDRFSGSIDSSSNSASLTVSGLK
TEDEADYYCQSSDSSAVVFGSGTKLTVL

Figure 76D

Wyeth PD1-28 VH (SEQ ID NO: 30035)

EVQLVQSGAEVKKPGASVKVSCKASGYRFTSYGISWVRQAPGQGLEWMGWISAYNGNTNYAQKLQGRVTMTTDTST
NTAYMELRSLRSDDTAVYYCARDADYSSGSGYWGQGTLVTVSS

Wyeth PD1-28 VL (SEQ ID NO: 30036)

SYELTQPPSVSVSPGQTARITCSGDALPKQYAYWYQQKPGQAPVMVIYKDTERPSGIPERFSGSSSGTKVTLTISGVQAE
DEADYYCQSADNSITYRVFGGGTKVTVL

Wyeth PD1-33 VH (SEQ ID NO: 30037)

QVQLVQSGAEVKKPGASVRVSCKASGYTLTSYYIHWVRQAPGQGLEWMGIINPRGATISYAQKFQGRVTMTRDTSTST
VYMELRNLKSEDTALYYCATAGIYGFDFDYWGRGTLVTVSS

Wyeth PD1-33 VL (SEQ ID NO: 30038)

QSALTQPASVSGSPGQSITISCTGTSNDVGGYNYVSWYQHHPGKAPKLIIYDVTNRPSGVSDRFSGSKSGNTASLTISGLL
AEDEGDYYCSSYTIVTNPEVLFGGGTKLTV

Wyeth PD1-35 VH (SEQ ID NO: 30039)

QVQLQESGPGLVKPSQTLSLTCTVSGGSISSGAYYWSWIRQHPGKGLEWIGYIYYNGNTYYNPSLRSLVTISVDASKNQF
SLKLSSVTAADTAVYYCARASDYVWGGYRYMDAFDIWGRGTLJTVSS

Wyeth PD1-35 VL (SEQ ID NO: 30040)

QSVLTQPPSASGTPGQRVTISCSGSNSNIGSNSVNWYQQLPGTAPKLLIYGNNQRPSGVPDRFSGSKSGTSASLAISGLQS
ENEADYYCAAWDDSLNGPVFGRGTKVTVL

Wyeth LOPD180 VH (SEQ ID NO: 30041)

QVQLQESGPGLVKPSQTLSLTCTVSGGSISSGAYYWSWIRQHPGKGLEWIGYIYYNGNTYYNPSLRSRVTISVDTSKNQF
SLKLSSVTAADTAVYYCVRASDYVWGGYHYFDAFDLWGRGTLVTVSS

Wyeth LOPD180 VL (SEQ ID NO: 30042)

QSVLTQPPSASGTPGQRVTISCSGSNSNIGSNSVNWYQQLPGTAPKLLIYGNNQRPSGVPDRFSGSKSGTSASLAISGLQS
EDEADYYCAAWDDSLNGPVFGGGTKVTVL

UCB Ab948 VH (SEQ ID NO: 30043)

EVQLQESGPGLVKPSQTLSLTCTVTGYSITSDYAWNWIRQPPGKKLEWMGYINYSGSTSYNPSLKSRVTISRDTSKNQFS
LKLSSVTAADTAVYYCARWIGSSAWYFDVWGQGTLVTVSS

UCB Ab948 VL (SEQ ID NO: 30044)

DVLMTQTPLSLSVTPGQPASISCRSGQNIVHSNGNTYLEWYLQKPGQSPKLLIYKVSNRFFGVPDRISGSGSGTDFTLKIS
RVEAEDVGVYFCFQGSHVPFTFGQGTKLEIK

Dana-Farber EH-12.2h7 VH (SEQ ID NO: 30045)

QVQLVQSGHEVKQPGASVKMSCKASGYSFTSSWIHWVRQAPGQGLEWIGYIYPSTGFTEYNQKFKDRATLTADKSTST
AYMELSSLRSEDTAVYYCARWRDSSGYHAMDYWGQGTLVTVSS

Dana-Farber EH-12.2h7 VH (SEQ ID NO: 30046)

EIVLTQSPATLSLSPGQRLTISCRASQSVSTSGYSYMHWYQQKPDQSPKLLIKFGSNLESGIPARFSGSGSGTDFTLTISSLE
PEDFATYYCQHSWEIPYTFGQGTKLEIK

Figure 76E

Sorrento RG1H10 VH (SEQ ID NO: 30047)

QVQLVQSGSELKKPGASVKISCKASGYIFSDNGVNWVRQAPGQGLEWMGWINTKIGNPTYAQGFTGRFVFSLDTSISTT
YLQISSLQAGDTAVYYCAREHDYYYGMDVWGQGTTVTVSS

Sorrento RG1H10 VL (SEQ ID NO: 30048)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-H2A-22-1S VH (SEQ ID NO: 30049)

QVQLVQSGSELKKPGASVKISCKASGYIFSDNGVNWVRQAPGQGLEWMGWINTKDGNPTYAQGFTGRFVFSLDTSIST
TYLQISSLQAGDTAVYYCAREHDYYYGMDVWGQGTTVTVSS

Sorrento RG1H10-H2A-22-1S VL (SEQ ID NO: 30050)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-H2A-27-2S VH (SEQ ID NO: 30051)

QVQLVQSGSELKKPGASVKISCKASGYIFSDNGVNWVRQAPGQGLEWMGWINTKTGNPTYAQGFTGRFVFSLDTSIST
TYLQISSLQAGDTAVYYCAREHDYYYGMDVWGQGTTVTVSS

Sorrento RG1H10-H2A-27-2S VL (SEQ ID NO: 30052)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-3C VH (SEQ ID NO: 30053)

QVQLVQSGSELKKPGASVKISCKASGYTFSDNGVNWVRQAPGQGLEWMGWINTKDGNPTYAQGFTGRFVFSLDTSIST
TYLQISSLQAGDTAVYYCAREHDYYYGMDVWGQGTTVTVSS

Sorrento RG1H10-3C VL (SEQ ID NO: 30054)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-16C VH (SEQ ID NO: 30055)

QVQLVQSGSELKKPGASVKISCKASGYTFSDNGVNWVRQAPGQGLEWMGWINTKTGNPTYAQGFTGRFVFSLDTSIST
TYLQISSLQAGDTAVYYCAREHDYYYGMDVWGQGTTVTVS

Sorrento RG1H10-16C VL (SEQ ID NO: 30056)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-17C VH (SEQ ID NO: 30057)

QVQLVQSGSELKKPGASVKISCKASGYKFSDNGVNWVRQAPGQGLEWMGWINTKSGNPTYAQGFTGRFVFSLDTSIST
TYLQISSLQAGDTAVYYCAREHDYYYGMDVWGQGTTVTVSS

Sorrento RG1H10-17C VL (SEQ ID NO: 30058)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Figure 76F

Sorrento RG1H10-19C VH (SEQ ID NO: 30059)

QVQLVQSGSELKKPGASVKISCKASGYKFSDNGVNWVRQAPGQGLEWMGWINTKTGNPTYAQGFTGRFVFSLDTSIST
TYLQISSLQAGDTAVYYCAREHDYYYGMDVWGQGTTVTVSS

Sorrento RG1H10-19C VL (SEQ ID NO: 30060)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-21C VH (SEQ ID NO: 30061)

QVQLVQSGSELKKPGASVKISCKASGYTFSDNGVNWVRQAPGQGLEWMGWINTKSGNPTYAQGFTGRFVFSLDTSIST
TYLQISSLQAGDTAVYYCAREHDYYYGMDVWGQGTTVTVSS

Sorrento RG1H10-21C VL (SEQ ID NO: 30062)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Sorrento RG1H10-23C2 VH (SEQ ID NO: 30063)

QVQLVQSGSELKKPGASVKISCKASGYKFSDNGVNWVRQAPGQGLEWMGWINTKDGNPTYAQGFTGRFVFSLDTSIST
TYLQISSLQAGDTAVYYCAREHDYYYGMDVWGQGTTVTVSS

Sorrento RG1H10-23C2 VL (SEQ ID NO: 30064)

QSALTQPPSASGSPGQSVTISCTGTSSDVGGYNYVSWYQHHPGKAPKLMIYEVSKRPSGVPDRFSGSKSAITASLTISGLL
TEDEADYYCSAWDDSLNADVFGGGTKVTVL

Rinat mAb 7 VH (SEQ ID NO: 30065)

QVQLVQSGAEVKKPGASVKVSCKASGYTFTSYWINWVRQAPGQGLEWMGNIYPGSSLTNYNEKFKNRVTMTRDTSTS
TVYMELSSLRSEDTAVYYCARLSTGTFAYWGQGTLVTVSS

Rinat mAb 7 VL (SEQ ID NO: 30066)

DIVMTQSPDSLAVSLGERATINCKSSQSLWDSGNQKNFLTWYQQKPGQPPKLLIYWTSYRESGVPDRFSGSGSGTDFTL
TISSLQAEDVAVYYCQNDYFYPHTFGGGTKVEIK

Celgene PD1AB-6 VH (SEQ ID NO: 30067)

EVQLVQSGAEVKKPGATVKISCKASGFNIKDTYMHWVQQAPGKGLEWMGRIDPANGDRKYDPKFQGRVTITADTSTD
TAYMELSSLRSEDTAVYYCARSGPVYYYGSSYVMDYWGQGTTVTVSS

Celgene PD1AB-6 VL (SEQ ID NO: 30068)

DIVMTQSPDSLAVSLGERATINCKSGQSVLYSSNQKNFLAWYQQKPGQPPKLLIYWASTRESGVPDRFSGSGSGTDFTL
TISSLQAEDVAVYYCHQYLYSWTFGQGTKLEIK

Figure 77A additional ICOS sequences

GSK 88.2 VH (SEQ ID NO: 30069)

QVQLQQPGAELVRPGASVKLSCKASGYSFTSYWINWVKQRPGQGLEWIGNIYPSDSYTNYNQMFKDKATLTVDKSSN
TAYMQLTSPTSEDSAVYYCTRWNLSYYFDNNYYLDYWGQGTTLTVSS

GSK 88.2 VL (SEQ ID NO: 30070)

DIVMTQAAPSVPVTPGESVSISCRSSKSLLHSNGNTYLYWFLQRPGQSPQLLIYRMSNLASGVPDRFSGSGSGTAFTLRIS
RVEAEDVGVYYCMQHLEYPWTFGGGTKLEIK

GSK 314.8 VH (SEQ ID NO: 30071)

QVQLQQPGTELMKPGASVKLSCKASGYTFTTYWMHWVKQRPGQGLEWIGEIDPSDSYVNYNQNFKGKATLTVDKSSS
TAYIQLSSLTSEDSAVYFCARSPDYYGTSLAWFDYWGQGTLVTVST

GSK 314.8 VL (SEQ ID NO: 30072)

DIVMTQAAPSVPVTPGESVSISCRSSKSPLHSNGNIYLYWFLQRPGQSPQLLIYRMSNLASGVPDRFSGSGSGTTFTLKISR
VEAEDVGVYYCMQHLEYPYTFGGGTKLEIK

GSK H2L5 VH (SEQ ID NO: 30073)

QVQLVQSGAEVKKPGSSVKVSCKASGYTFTDYAMHWVRQAPGQGLEWMGLISIYSDHTNYNQKFQGRVTITADKSTS
TAYMELSSLRSEDTAVYYCGRNNYGNYGWYFDVWGQGTTVTVSS

GSK H2L5 VL (SEQ ID NO: 30074)

EIVLTQSPATLSLSPGERATLSCSASSSVSYMHWYQQKPGQAPRLLIYDTSKLASGIPARFSGSGSGTDYTLTISSLEPEDF
AVYYCFQGSGYPYTFGQGTKLEIK

Jounce 37A10S713 VH (SEQ ID NO: 30075)

EVQLVESGGGLVQPGGSLRLSCAASGFTFSDYWMDWVRQAPGKGLVWVSNIDEDGSITEYSPFVKGRFTISRDNAKNT
LYLQMNSLRAEDTAVYYCTRWGRFGFDSWGQGTLVTVSS

Jounce 37A10S713 VL (SEQ ID NO: 30076)

DIVMTQSPDSLAVSLGERATINCKSSQSLLSGSFNYLTWYQQKPGQPPKLLIFYASTRHTGVPDRFSGSGSGTDFTLTISS
LQAEDVAVYYCHHHYNAPPTFGPGTKVDIK

Japan Tobacco Jmab-136 VH (SEQ ID NO: 30077)

QVQLVQSGAEVKKPGASVKVSCKASGYTFTGYYMHWVRQAPGQGLEWMGWINPHSGGTNYAQKFQGRVTMTRDTS
ISTAYMELSRLRSDDTAVYYCARTYYYDSSGYYHDAFDIWGQGTMVTVSS

Japan Tobacco Jmab-136 VL (SEQ ID NO: 30078)

DIQMTQSPSSVSASVGDRVTITCRASQGISRLLAWYQQKPGKAPKLLIYVASSLQSGVPSRFSGSGSGTDFTLTISSLQPE
DFATYYCQQANSFPWTFGQGTKVEIK

Japan Tobacco Jmab-138 VH (SEQ ID NO: 30079)

EVQLVESGGGLVQPGGSLRLSCAASGFTFSSYDMHWVRQATGKGLEWVSAIGTAGDTYYPGSVKGRFTISRENAKNSL
YLQMNSLRAGDTAVYYCVRDNRKVTHEHYYYYGMDVWGQGTTVTVSS

Japan Tobacco Jmab-138 VL (SEQ ID NO: 30080)

EIVLTQSPGTLSLSPGERATLSCRASQNIRSSYLAWYQQKPGQAPGLLIYGASSRATGIPDRFSGSGSGTDFTLTISRLEPE
DFAVYYCQQFGSSPMCSFGQGTKLEIK

Figure 77B

Japan Tobacco Jmab-139 VH (SEQ ID NO: 30081)

EVQLVESGGGLVQPGGSLRLSCAASGFTFSSYDMHWVRQATGKGLEWVSAIGTAGDTYYPGSVKGRFTISRENAKNSL
YLQMNSLRAGDTAVYYCVRDKRTVTHEHYYYYGMDVWGQGTTVTVSS

Japan Tobacco Jmab-139 VL (SEQ ID NO: 30082)

EIVLTQSPGTLSLSPGERATLSCRASQSISSSSLAWYQQKPGQAPGLLIFGASSRATGIPDRFSGSGSGTDFTLTISRLEPED
FAVYYCQQFGSSPMCSFGQGTKLEIK

Figure 78A additional PD-L1 sequences

AstraZeneca/Celgene/MedImmune 2.14H9 OPT VH (SEQ ID NO: 30083)

EVQLVESGGGLVQPGGSLRLSCAASGFTFSRYWMSWVRQAPGKGLEWVANIKQDGSEKYYVDSVKGRFTISRDNAKN
SLYLQMNSLRAEDTAVYYCAREGGWFGELAFDYWGQGTLVTVSS

AstraZeneca/Celgene/MedImmune 2.14H9 OPT VL (SEQ ID NO: 30084)

EIVLTQSPGTLSLSPGERATLSCRASQRVSSSYLAWYQQKPGQAPRLLIYDASSRATGIPDRFSGSGSGTDFTLTISRLEPE
DFAVYYCQQYGSLPWTFGQGTKVEIK

Genentech atezolizumab VH (SEQ ID NO: 30085)

EVQLVESGGGLVQPGGSLRLSCAASGFTFSDSWIHWVRQAPGKGLEWVAWISPYGGSTYYADSVKGRFTISADTSKNT
AYLQMNSLRAEDTAVYYCARRHWPGGFDYWGQGTLVTVSA

Genentech atezolizumab VL (SEQ ID NO: 30086)

DIQMTQSPSSLSASVGDRVTITCRASQDVSTAVAWYQQKPGKAPKLLIYSASFLYSGVPSRFSGSGSGTDFTLTISSLQPE
DFATYYCQQYLYHPATFGQGTKVEIKR

Merck/Pfizer avelumab VH (SEQ ID NO: 30087)

EVQLLESGGGLVQPGGSLRLSCAASGFTFSSYIMMWVRQAPGKGLEWVSSIYPSGGITFYADTVKGRFTISRDNSKNTL
YLQMNSLRAEDTAVYYCARIKLGTVTTVDYWGQGTLVTVSS

Merck/Pfizer avelumab VL (SEQ ID NO: 30088)

QSALTQPASVSGSPGQSITISCTGTSSDVGGYNYVSWYQQHPGKAPKLMIYDVSNRPSGVSNRFSGSKSGNTASLTISGL
QAEDEADYYCSSYTSSSTRVFGTGTKVTVL

Medarex 12A4 VH (SEQ ID NO: 30089)

QVQLVQSGAEVKKPGSSVKVSCKTSGDTFSTYAISWVRQAPGQGLEWMGGIIPIFGKAHYAQKFQGRVTITADESTSTA
YMELSSLRSEDTAVYFCARKFHFVSGSPFGMDVWGQGTTVTVSS

Medarex 12A4 VL (SEQ ID NO: 30090)

EIVLTQSPATLSLSPGERATLSCRASQSVSSYLAWYQQKPGQAPRLLIYDASNRATGIPARFSGSGSGTDFTLTISSLEPED
FAVYYCQQRSNWPTFGQGTKVEIK

Medarex 3G10 VH (SEQ ID NO: 30091)

QVQLVQSGAEVKKPGASVKVSCKASGYTFTDYGFSWVRQAPGQGLEWMGWITAYNGNTNYAQKLQGRVTMTTDTS
TSTVYMELRSLRSDDTAVYYCARDYFGMDVWGQGTTVTVSS

Medarex 3G10 VL (SEQ ID NO: 30092)

EIVLTQSPATLSLSPGERATLSCRASQSVSSYLVWYQQKPGQAPRLLIYDASNRATGIPARFSGSGSGTDFTLTISSLEPED
FAVYYCQQRSNWPRTFGQGTKVEIK

Medarex 10A5 VH (SEQ ID NO: 30093)

QVQLVQSGAEVKKPGASVKVSCKASGYTFTSYDVHWVRQAPGQRLEWMGWLHADTGITKFSQKFQGRVTITRDTSAS
TAYMELSSLRSEDTAVYYCARERIQLWFDYWGQGTLVTVSS

Medarex 10A5 VL (SEQ ID NO: 30094)

DIQMTQSPSSLSASVGDRVTITCRASQGISSWLAWYQQKPEKAPKSLIYAASSLQSGVPSRFSGSGSGTDFTLTISSLQPED
FATYYCQQYNSYPYTFGQGTKLEIK

Figure 78B

Amplimmune/GSK/MedImmune h3D10 Var1 VH (SEQ ID NO: 30095)

QVQLVQSGAEVKKPGASVKVSCKASGYTFPDYYMNWVRQAPGQGLEWMGDIDPNYGGTNYAQKFQGRVTMTRDTS
ISTAYMELSRLRSDDTAVYYCARGALTDWGQGTMVTVSS

Amplimmune/GSK/MedImmune h3D10 Var1 VL (SEQ ID NO: 30096)

EIVLTQSPATLSLSPGERATLSCRASSSVSYIYWFQQKPGQAPRLLIYAAFNRATGIPARFSGSGSGTDYTLTISSLEPEDFA
VYYCQQWSNNPLTFGQGTKVEIK

Amplimmune/GSK/MedImmune h3D10 Var2 VH (SEQ ID NO: 30097)

QVQLVQSGAEVKKPGASVKVSCKASGYTFPDYYMNWVRQAPGQSLEWMGDIDPNYGGTNYNQKFQGRVTMTRDTSI
STAYMELSRLRSDDTAVYYCARGALTDWGQGTMVTVSS

Amplimmune/GSK/MedImmune h3D10 Var2 VL (SEQ ID NO: 30098)

EIVLTQSPATLSLSPGERATLSCRASSSVSYIYWFQQKPGQSPRPLIYAAFNRATGIPARFSGSGSGTDYTLTISSLEPEDFA
VYYCQQWSNNPLTFGQGTKVEIK

Amplimmune/GSK/MedImmune h3D10 Var3 VH (SEQ ID NO: 30099)

QVQLVQSGAEVKKPGASVKVSCKASGYTFPDYYMNWVRQAPGQSLEWMGDIDPNYGGTNYNQKFQGRVTMTRDTSI
STAYMELSRLRSDDTAVYYCARGALTDWGQGTMVTVSS

Amplimmune/GSK/MedImmune h3D10 Var3 VL (SEQ ID NO: 30100)

QIVLTQSPATLSLSPGERATLSCRASSSVSYIYWFQQKPGQSPRPLIYATFNLASGIPARFSGSGSGTSYTLTISRLEPEDFA
VYYCQQWSNNPLTFGQGTKVEIK

Amplimmune/GSK/MedImmune h3D10 Var4 VH (SEQ ID NO: 30101)

EVQLVQSGAEVKKPGASVKVSCKASGYTFPDYYMNWVRQAPGQSLEWMGDIDPNYGGTNYNQKFQGRVTMTVDRS
SSTAYMELSRLRSDDTAVYYCARGALTDWGQGTMVTVSS

Amplimmune/GSK/MedImmune h3D10 Var4 VL (SEQ ID NO: 30102)

EIVLTQSPATLSLSPGERATLSCRASSSVSYIYWFQQKPGQSPRPLIYAAFNRATGIPARFSGSGSGTDYTLTISSLEPEDFA
VYYCQQWSNNPLTFGQGTKVEIK

Amplimmune/GSK/MedImmune h3D10 Var5 VH (SEQ ID NO: 30103)

EVQLVESGGGLVQPGRSLRLSCTASGYTFPDYYMNWVRQAPGKGLEWVGDIDPNYGGTTYNQSVKGRFTISVDRSKSI
AYLQMSSLKTEDTAVYYCARGALTDWGQGTMVTVSS

Amplimmune/GSK/MedImmune h3D10 Var5 VL (SEQ ID NO: 30104)

DIQLTQSPSILSASVGDRVTITCRASSSVSYIYWFQQKPGKAPKPLIYATFNLASGVPSRFSGSGSGTSYTLTISSLQPEDFA
TYYCQQWSNNPLTFGQGTKVEIK

Amplimmune/GSK/MedImmune h3D10 Var6 VH (SEQ ID NO: 30105)

EVQLVESGGGLVQPGRSLRLSCTASGYTFPDYYMNWVRQAPGKGLEWVGDIDPNYGGTTYAASVKGRFTISVDRSKSI
AYLQMSSLKTEDTAVYYCTRGALTDWGQGTMVTVSS

Amplimmune/GSK/MedImmune h3D10 Var6 VL (SEQ ID NO: 30106)

EIVLTQSPATLSLSPGERATLSCRASSSVSYIYWFQQKPGQAPRLLIYAAFNRATGIPARFSGSGSGTDYTLTISSLEPEDFA
VYYCQQWSNNPLTFGQGTKVEIK

Figure 78C

Amplimmune/GSK/MedImmune h3D10 Var7 VH (SEQ ID NO: 30107)

QVQLVQSGAEVKKPGASVKVSCKASGYTFPDYYMNWVRQAPGQGLEWMGDIDPNYGGTNYAQKFQGRVTMTRDTS
ISTAYMELSRLRSDDTAVYYCARGALTDWGQGTMVTVSS

Amplimmune/GSK/MedImmune h3D10 Var7 VL (SEQ ID NO: 30108)

DIQLTQSPSSLSASVGDRVTITCRASSGVSYIYWFQQKPGKAPKLLIYAAFNLASGVPSRFSGSGSGTEYTLTISSLQPEDF
ATYYCQQWSNNPLTFGQGTKVEIK

Amplimmune/GSK/MedImmune h3D10 Var8 VH (SEQ ID NO: 30109)

EVQLVESGGGLVQPGRSLRLSCTASGYTFPDYYMNWVRQAPGKGLEWVGDIDPNYGGTTYNQSVKGRFTISVDRSKSI
AYLQMSSLKTEDTAVYYCARGALTDWGQGTMVTVSS

Amplimmune/GSK/MedImmune h3D10 Var8 VL (SEQ ID NO: 30110)

QIVLTQSPATLSLSPGERATLSCRASSSVSYIYWFQQKPGQSPRPLJYATFNLASGIPARFSGSGSGTSYTLTISRLEPEDFA
VYYCQQWSNNPLTFGQGTKVEIK

Amplimmune/GSK/MedImmune h3D10 Var9 VH (SEQ ID NO: 30111)

EVQLVESGGGLVQPGRSLRLSCTASGYTFPDYYMNWVRQAPGKGLEWVGDIDPNYGGTTYNQSVKGRFTISVDRSKSI
AYLQMSSLKTEDTAVYYCARGALTDWGQGTMVTVSS

Amplimmune/GSK/MedImmune h3D10 Var9 VL (SEQ ID NO: 30112)

DIQLTQSPSSLSASVGDRVTITCRASSGVSYIYWFQQKPGKAPKPLIYAAFNLASGVPSRFSGSGSGTEYTLTISSLQPEDF
ATYYCQQWSNNPLTFGQGTKVEIK

Amplimmune/GSK/MedImmune h3D10 Var10 VH (SEQ ID NO: 30113)

EVQLVESGGGLVQPGRSLRLSCTASGYTFPDYYMNWVRQAPGKGLEWVGDIDPNYGGTTYNQSVKGRFTISVDRSKSI
AYLQMSSLKTEDTAVYYCARGALTDWGQGTMVTVSS

Amplimmune/GSK/MedImmune h3D10 Var10 VL (SEQ ID NO: 30114)

DIQLTQSPSILSASVGDRVTITCRASSSVSYIYWFQQKPGKAPKPLIYATFNLASGVPSRFSGSGSGTSYTLTISSLQPEDFA
TYYCQQWSNNPLTFGQGTKVEIK

Amplimmune/GSK/MedImmune h3D10 Var11 VH (SEQ ID NO: 30115)

EVQLVESGGGLVQPGRSLRLSCTASGYTFPDYYMNWVRQAPGKGLEWVGDIDPNYGGTTYAASVKGRFTISVDRSKSI
AYLQMSSLKTEDTAVYYCTRGALTDWGQGTMVTVSS

Amplimmune/GSK/MedImmune h3D10 Var11 VL (SEQ ID NO: 30116)

EIVLTQSPATLSLSPGERATLSCRASSSVSYIYWFQQKPGQAPRLLIYAAFNRATGIPARFSGSGSGTDYTLTISSLEPEDFA
VYYCQQWSNNPLTFGQGTKVEIK

Amplimmune/GSK/MedImmune h3D10 Var12 VH (SEQ ID NO: 30117)

QVQLVQSGAEVKKPGASVKVSCKASGYTFPDYYMNWVRQAPGQGLEWMGDIDPNYGGTNYAQKFQGRVTMTRDTS
ISTAYMELSRLRSDDTAVYYCARGALTDWGQGTMVTVSS

Amplimmune/GSK/MedImmune h3D10 Var12 VL (SEQ ID NO: 30118)

DIQLTQSPSSLSASVGDRVTITCRASSGVSYIYWFQQKPGKAPKLLIYAAFNLASGVPSRFSGSGSGTEYTLTISSLQPEDF
ATYYCQQWSNNPLTFGQGTKVEIK

Figure 78D

Amplimmune/GSK/MedImmune h3D10 Var13 VH (SEQ ID NO: 30119)

EVQLVESGGGLVQPGRSLRLSCTASGYTFPDYYMNWVRQAPGKGLEWVGDIDPNYGGTTYNQSVKGRFTISVDRSKSI
AYLQMSSLKTEDTAVYYCARGALTDWGQGTMVTVSS

Amplimmune/GSK/MedImmune h3D10 Var13 VL (SEQ ID NO: 30120)

QIVLTQSPATLSLSPGERATLSCRASSSVSYIYWFQQKPGQSPRPLIYATFNLASGIPARFSGSGSGTSYTLTISRLEPEDFA
VYYCQQWSNNPLTFGQGTKVEIK

Amplimmune/GSK/MedImmune h3D10 Var14 VH (SEQ ID NO: 30121)

EVQLVQSGAEVKKPGASVKVSCKASGYTFPDYYMNWVRQAPGQSLEWMGDIDPNYGGTNYNQKFQGRVTMTVDRS
SSTAYMELSRLRSDDTAVYYCARGALTDWGQGTMVTVSS

Amplimmune/GSK/MedImmune h3D10 Var14 VL (SEQ ID NO: 30122)

DIQLTQSPSILSASVGDRVTITCRASSSVSYIYWFQQKPGKAPKPLIYATFNLASGVPSRFSGSGSGTSYTLTISSLQPEDFA
TYYCQQWSNNPLTFGQGTKVEIK

Eli Lily Antibody A VH (SEQ ID NO: 30123)

QVQLVQSGAEVKKPGSSVKVSCKASGGTFSSYAISWVRQAPGQGLEWMGGIIPIFGTANYAQKFQGRVTITADKSTSTA
YMELSSLRSEDTAVYYCARSPDYSPYYYYGMDVWGQGTTVTVSS

Eli Lily Antibody A VL (SEQ ID NO: 30124)

QSVLTQPPSASGTPGQRVTISCSGSSSNIGSNTVNWYQQLPGTAPKLLIYGNSNRPSGVPDRFSGSKSGTSASLAISGLQSE
DEADYYCQSYDSSLSGSVFGGGIKLTVLG

Cytomyx C5H9v2 VH (SEQ ID NO: 30125)

EVQLLESGGGLVQPGGSLRLSCAASGFTFSSYAMSWVRQAPGKGLEWVSSIWRNGIVTVYADSVKGRFTISRDNSKNT
LYLQMNSLRAEDTAVYYCAKWSAAFDYWGQGTLVTVSS

Cytomyx C5H9v2 VL (SEQ ID NO: 30126)

DIQMTQSPSSLSASVGDRVTITCRASQSISSYLNWYQQKPGKAPKLLIYAASSLQSGVPSRFSGSGSGTDFTLTISSLQPED
FATYYCQQDNGYPSTFGGGTKVEIKR

Dana-Farber/Novartis Humanized 29E.2A3 VH (SEQ ID NO: 30127)

CKASGYTFTSYVMHWVKQAPGQRLEWIGYVNPFNDGTKYNEMFKGRATLTSDKSTSTAYMELSSLRSEDTAVYYCAR
QAWGYPWGQGTLVTVSS

Dana-Farber/Novartis Humanized 29E.2A3 VL (SEQ ID NO: 30128)

DIVLTQSPATLSLSPGERATLSCRATESVEYYGTSLVQWYQQKPGQPPKLLIYAASSVDSGVPSRFSGSGSGTDFTLTINS
LEAEDAATYFCQQSRRVPYTFGQGTKLEIK

Dana-Farber/Novartis 1B9 VH (SEQ ID NO: 30129)

DVQLQESGPGLVKPSQSLSLTCTVTGYSITSDHAWNWIRQVPGNKLEWMGYITYRGSTTYSPSLKSRISITRDTSKNQFF
LQLNSVTTEDTATYYCARSMITGYYVMDYWGQGTSVTVSS

Dana-Farber/Novartis 1B9 VL (SEQ ID NO: 30130)

DIVMTQSHKFMSTSLGDRVTITCKASQDVGISVVWYQQKPGQSPKLLIYWASTRHTGVPDRFTGSGSGTDFTLTINNVQ
SEDLADYFCQQYSSYPLTVGAGTKLELK

Figure 78E

Dana-Farber/Novartis 4H1 VH (SEQ ID NO: 30131)

DVQLQESGPGLVKPSQSLSLTCTVTDYSITSDYAWTWIRQFPGNKLEWMGYITYRGTTRYNPSLTSRISFTRDTSKNQLF
LQLNSVTTEDTGTYCCARSMITTGYYAMDYWGQGTSVTSS

Dana-Farber/Novartis 4H1 VL (SEQ ID NO: 30132)

DIVMTQSHKFMSTSVGDRVSISCKASQDVGISVAWYQQKPGQSPKLLIYWASTRHTGVPVRFTGSGSGTDFTLTISNVQ
SEDLADYFCQQYSSYPPTFGAGTKLELK

Dana-Farber/Novartis mAb-42 VH (SEQ ID NO: 30133)

QVQLVQSGAEVKKPGSSVKVSCKASGGTFSSYAISWVRQAPGQGLEWMGGIIPIFGTANYAQKFQGRVTITADKSTSTA
YMELSSLRSEDTAVYYCARGRQMFGAGIDFWGPGTLVTVSS

Dana-Farber/Novartis mAb-42 VL (SEQ ID NO: 30134)

NFMLTQPHSVSESPGKTVTISCTRSSGSIDSNYVQWYQQRPGSAPTTVIYEDNQRPSGVPDRFSGSIDSSSNSASLTISGLK
TEDEADYYCQSYDSNNRHVIFGGGTKLTVL

Dana-Farber/Novartis BAP058-03 VH (SEQ ID NO: 30135)

EVQLVQSGAEVKKPGATVKISCKVSGYTFTSYWMYWVRQATGQGLEWMGRIDPNSGSTKYNEKFKNRVTITADKSTS
TAYMELSSLRSEDTAVYYCARDYRKGLYAMDYWGQGTTVTVSS

Dana-Farber/Novartis BAP058-03 VL (SEQ ID NO: 30136)

EIVLTQSPDFQSVTPKEKVTITCKASQDVGTAVAWYLQKPGQSPQLLIYWASTRHTGVPDRFSGSGSGTDFTLKISRVEA
EDVGVYYCQQYNSYPLTFGQGTKVEIK

Dana-Farber/Novartis BAP058-04 VH (SEQ ID NO: 30137)

EVQLVQSGAEVKKPGESLRISCKGSGYTFTSYWMYWVRQAPGQGLEWMGRIDPNSGSTKYNEKFKNRVTISVDTSKN
QFSLKLSSVTAADTAVYYCARDYRKGLYAMDYWGQGTTVTVSS

Dana-Farber/Novartis BAP058-04 VL (SEQ ID NO: 30138)

EIVLTQSPDFQSVTPKEKVTITCKASQDVGTAVAWYLQKPGQSPQLLIYWASTRHTGVPSRFSGSGSGTDFTFTISSLQPE
DIATYYCQQYNSYPLTFGQGTKVEIK

Dana-Farber/Novartis BAP058-06 VH (SEQ ID NO: 30139)

EVQLVQSGAEVKKPGESLRISCKGSGYTFTSYWMYWIRQPPGKGLEWIGRIDPNSGSTKYNEKFKNRVTITADKSTSTA
YMELSSLRSEDTAVYYCARDYRKGLYAMDYWGQGTTVTVSS

Dana-Farber/Novartis BAP058-06 VL (SEQ ID NO: 30140)

EIVLTQSPDFQSVTPKEKVTITCKASQDVGTAVAWYLQKPGQSPQLLIYWASTRHTGVPSRFSGSGSGTDFTFTISSLQPE
DIATYYCQQYNSYPLTFGQGTKVEIK

Dana-Farber/Novartis BAP058-07 VH (SEQ ID NO: 30141)

QVQLVQSGAEVKKPGASVKVSCKASGYTFTSYWMYWIRQSPSRGLEWLGRIDPNSGSTKYNEKFKNRFTISRDDSKNT
AYLQMNSLKTEDTAVYYCARDYRKGLYAMDYWGQGTTVTVSS

Dana-Farber/Novartis BAP058-07 VL (SEQ ID NO: 30142)

EIVLTQSPATLSLSPGERATLSCKASQDVGTAVAWYLQKPGQSPQLLIYWASTRHTGIPPRFSGSGYGTDFTLTINNIESE
DAAYYFCQQYNSYPLTFGQGTKVEIK

Figure 78F

Dana-Farber/Novartis BAP058-11 VH (SEQ ID NO: 30143)

EVQLVQSGAEVKKPGATVKISCKVSGYTFTSYWMYWVRQATGQGLEWMGRIDPNSGSTKYNEKFKNRVTITADKSTS
TAYMELSSLRSEDTAVYYCARDYRKGLYAMDYWGQGTTVTVSS

Dana-Farber/Novartis BAP058-11 VL (SEQ ID NO: 30144)

DVVMTQSPLSLPVTLGQPASISCKASQDVGTAVAWYQQKPGQAPRLLIYWASTRHTGVPSRFSGSGSGTEFTLTISSLQP
DDFATYYCQQYNSYPLTFGQGTKVEIK

Dana-Farber/Novartis BAP058-13 VH (SEQ ID NO: 30145)

EVQLVQSGAEVKKPGATVKISCKVSGYTFTSYWMYWVRQARGQRLEWIGRIDPNSGSTKYNEKFKNRFTISRDNSKNT
LYLQMNSLRAEDTAVYYCARDYRKGLYAMDYWGQGTTVTVSS

Dana-Farber/Novartis BAP058-13 VL (SEQ ID NO: 30146)

AIQLTQSPSSLSASVGDRVTITCKASQDVGTAVAWYLQKPGQSPQLLIYWASTRHTGVPSRFSGSGSGTDFTFTISSLEAE
DAATYYCQQYNSYPLTFGQGTKVEIK

Sorrento H6 VH (SEQ ID NO: 30147)

QMQLVQSGAEVKKPGSSVKVSCKASGGTFSSYAISWVRQAPGQGLEWMGGIIPIFGTANYAQKFQGRVTITADESTSTA
YMELSSLRSEDTAVYYCARGNIVATITPLDYWGQGTLVTVSS

Sorrento H6 VL (SEQ ID NO: 30148)

SYELMQPPSVSVAPGKTATIACGGENIGRKTVHWYQQKPGQAPVLVIYYDSDRPSGIPERFSGSNSGNTATLTISRVEAG
DEADYYCQVWDSSSDHRIFGGGTKLTVL

Sorrento RC5 VH (SEQ ID NO: 30149)

EVQLLESGGGVVQPGGSLRLSCAASGFTFSSYWMSWVRQAPGKGLEWVANIKQDGSEKYYVDSVKGRFTISRDNSKN
TVSLQMNSLRAEDTAVYYCAKDRYYNFPLGMDVWGQGTTVTVSS

Sorrento RC5 VL (SEQ ID NO: 30150)

AIRMTQSPSSLSASVGDRVTITCRASQSISSYLNWYQQKPGKAPKLLIYTTSSLKSGVPSRFSGSGSGTDFTLTISRLQPED
FATYYCQQSYSSTWTFGRGTKVEIK

Sorrento SH1A1Q VH (SEQ ID NO: 30151)

EVQLVQSGAEVKKPGSSVKVSCKASGGTFSSYAISWVRQAPGQGLEWMGGIIPIFGTANYAQKFQGRVTITADKSTSTA
YMELSSLRSEDTAVYYCAREGTIYDSSGYSFDYWGQGTLVTVSS

Sorrento SH1A1Q VL (SEQ ID NO: 30152)

QSVLTQPPSVSAAPGQKVTISCSGNNSNIANNYVSWYQQLPGTAPKLLIYDNNYRPSGIPDRFSGSKSGTSATLDITGLQT
GDEADYYCGVWDGSLTTGVFGGGTKLTVL

Sorrento SH1B3 VH (SEQ ID NO: 30153)

QVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1B3 VL (SEQ ID NO: 30154)

LPVLTQPASVSGSPGQSITISCTGTTSDIGGYDYVSWYQQHPGKAPKLMIYDVSKRPSGVSNRFSGSKSGNTASLTISGLQ
AEDEADYYCSSYTSSSTHVFGTGTKLTVL

Figure 78G

Sorrento SH1D1 VH (SEQ ID NO: 30155)

EVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1D1 VL (SEQ ID NO: 30156)

QSALTQPASVSGSPGQSITISCTGTSSDVGGYNYVSWYQQHPGKAPKLMIYDVSNRPSGVSNRFSGSKSGNTASLTISGL
QAEDEADYYCSSYRSSTLGPVFGGGTKLTVL

Sorrento SH1D2 VH (SEQ ID NO: 30157)

QVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1D2 VL (SEQ ID NO: 30158)

QAGLTQPPSVSEAPRQRVTISCSGSSSNIGNNAVNWYQQLPGKAPKLLIYYDDLLPSGVSDRFSGSKSGTSASLAISGLQS
EDEADYYCAAWDDSLNGYVFGTGTKLTVL

Sorrento SH1D12 VH (SEQ ID NO: 30159)

EVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1D12 VL (SEQ ID NO: 30160)

QSALTQPRSVSGSPGQSVTISCTGTSSDVGGYNYVSWYQQHPGKAPKLMIYDVSKRPSGVPDRFSGSKSGNTASLTISGL
QAEDEADYYCSSYTSSTTHVFGTGTKVTVL

Sorrento SH1E1 VH (SEQ ID NO: 30161)

EVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1E1 VL (SEQ ID NO: 30162)

QSVVTQPPSVSAAPGQKVTISCSGSSSNIGNNYVSWYQQLPGTAPKLLIYDNNKRPSGIPDRFSGSKSGTSATLGITGLQT
GDEADYYCGTWDSSLSVWVFGGGTQLTVL

Sorrento SH1G9 VH (SEQ ID NO: 30163)

QVQLVESGGGVVQPGRSLRLSCAASGFTFSSYAMHWVRQAPGKGLEWVAVISFDGSNKYYADSVRGRFTISRDNSKNT
LYLQMNSLRTEDTAVYYCARGWLDRDIDYWGQGTLVTVSS

Sorrento SH1G9 VL (SEQ ID NO: 30164)

QSVLTQPASVSGSPGQSITISCTGTSSDVGGYNYVSWYQQHPGRAPRLMIYDVSNRPSGVSNRFSGSKSGNTASLTISGL
QAEDEGDYYCSSYTSGGTLGPVFGGGTKLTVL

Sorrento SH1E6 VH (SEQ ID NO: 30165)

QVQLVQSGAEVKKPGSSVKVSCKASGGTFSRYGVHWVRQAPGQGLEWMGRLIPIVSMTNYAQKFQDRVSITTDKSTG
TAYMELRSLTSEDTALYYCASVGQQLPWVFFAWGQGTLVTVSS

Sorrento SH1E6 VL (SEQ ID NO: 30166)

QSVVTQPPSVSAAPGQKVTISCSGSSSNIGNNYVSWYQQLPGTAPKLLIYDNNKRPSGIPDRFSGSKSGTSATLGITGLQT
GDEADYYCGTWDSSLSAVVFGGGTKLTVL

Figure 78H

Sorrento SH1A2 VH (SEQ ID NO: 30167)

QMQLVQSGGGVVQPGRSLRLSCAASGFTFSSYAMHWVRQAPGKGLEWVAVISFDGSNKYYADSVRGRFTISRDNSKN
TLYLQMNSLRTEDTAVYYCARGWLDRDIDYWGQGTLVTVSS

Sorrento SH1A2 VL (SEQ ID NO: 30168)

QSVVTQPPSVSAAPGQKVTISCSGSSSNIGNNYVSWYQQVPGTAPKLLIYDNNKRPSGIPDRFSGSNSDTSATLGITGLQT
GDEADYYCGTWDSSLSAWVFGGGTKLTVL

Sorrento SH1B1 VH (SEQ ID NO: 30169)

QVQLVQSGGGVVQPGRSLRLSCAASGFTFSSYAMHWVRQAPGKGLEWVAVISFDGSNKYYADSVRGRFTISRDNSKN
TLYLQMNSLRTEDTAVYYCARGWLDRDIDYWGQGTLVTVSS

Sorrento SH1B1 VL (SEQ ID NO: 30170)

QSVVTQPPSVSAAPGQKVTISCSGSSSNIGNNYVSWYQQLPGTAPKLLIYDNNKRPSGIPDRFSGSKSGTSATLGITGLQT
GDEADYYCGTWDSSLSAGSVVFGGGTKLTVL

Sorrento H6B1L VH (SEQ ID NO: 30171)

QMQLVQSGAEVKKPGSSVKVSCKASGGTFSSYAYSWVRQAPGQGLEWMGGIIPSFGTANYAQKFQGRVTITADESTST
AYMELSSLRSEDTAVYYCARGPIVATITPLDYWGQGTLVTVSS

Sorrento H6B1L VL (SEQ ID NO: 30172)

SYELMQPPSVSVAPGKTATIACGGENIGRKTVHWYQQKPGQAPVLVIYYDSDRPSGIPERFSGSNSGNTATLTISRVEAG
DEADYYCLVWDSSSDHRIFGGGTKLTVL

Sorrento H6A1 VH (SEQ ID NO: 30173)

QMQLVQSGAEVKKPGSSVKVSCKASGGTFSSYAYSWVRQAPGQGLEWMGGIIPIFGTANYAQKFQGRVTITADESTST
AYMELSSLRSEDTAVYYCARGPIVATITPLDYWGQGTLVTVSS

Sorrento H6A1 VL (SEQ ID NO: 30174)

SYELMQPPSVSVAPGKTATIACGGENIGRKTVHWYQQKPGQAPVLVIYYDSDRPSGIPERFSGSNSGNTATLTISRVEAG
DEADYYCQVWDSSSDHRIFGGGTKLTVL

Sorrento H6B1 VH (SEQ ID NO: 30175)

QMQLVQSGAEVKKPGSSVKVSCKASGGTFSSYAYSWVRQAPGQGLEWMGGIIPSFGTANYAQKFQGRVTITADESTST
AYMELSSLRSEDTAVYYCARGPIVATITPLDYWGQGTLVTVSS

Sorrento H6B1 VL (SEQ ID NO: 30176)

SYELMQPPSVSVAPGKTATIACGGENIGRKTVHWYQQKPGQAPVLVIYYDSDRPSGIPERFSGSNSGNTATLTISRVEAG
DEADYYCQVWDSSSDHRIFGGGTKLTVL

Sorrento H6B2 VH (SEQ ID NO: 30177)

QMQLVQSGAEVKKPGSSVKVSCKASGGTFSSYAISWVRQAPGQGLEWMGGIIPAFGTANYAQKFQGRVTITADESTST
AYMELSSLRSEDTAVYYCARGPIVATITPLDYWGQGTLVTVSS

Sorrento H6B2 VL (SEQ ID NO: 30178)

SYELMQPPSVSVAPGKTATIACGGENIGRKTVHWYQQKPGQAPVLVIYYDSDRPSGIPERFSGSNSGNTATLTISRVEAG
DEADYYCQVWDSSSDHRIFGGGTKLTVL

Figure 78I

Sorrento G12 VH (SEQ ID NO: 30179)

EVQLVQSGAEVKKPGASVKVSCKASGYTFTGYYMHWVRQAPGQGLEWMGWINPNSDNTGSAQKFQGRVFMTKTTS
LNTAYMELSGLRSEDTAIYYCARERSSGYFDFWGQGTLVTVSS

Sorrento G12 VL (SEQ ID NO: 30180)

DIVMTQSPSSLSASVGDRVTITCRASQSISSYLNWYQQKPGKAPKLLIYAASSLQSGVPSRFSGSGSGTDFTLTISSLQPED
FATYYCQQSYSTPITFGQGTRLEIK

Sorrento RSA1 VH (SEQ ID NO: 30181)

EVQLVQSGGGLVQPGGSLRLSCAASGFTFSSYSMNWVRQAPGKGLEWVSYISSSSSTIYYADSVKGRFTISRDNAKNSL
YLQMNSLRDEDTAVYYCARGDYYYGMDVWGQGTTVTVSS

Sorrento RSA1 VL (SEQ ID NO: 30182)

NIQMTQSPSSVSASVGDRVTITCRASQDISRWLAWYQQKPGKAPKLLIYAASSLQSGVPSRFSGSGSGTDFALTISSLQPE
DFATYYCQQADSFFSITFGQGTRLEIK

Sorrento RA3 VH (SEQ ID NO: 30183)

QMQLVQSGAEVKKPGSSVKVSCKASGGTFSRYGVHWVRQAPGQGLEWMGRLIPIVSMTNYAQKFQDRVSITTDKSTG
TAYMELRSLTSEDTALYYCASVGQQLPWVFFAWGQGTLVTVSS

Sorrento RA3 VL (SEQ ID NO: 30184)

DIQMTQSPSSLSASVGDRVTITCQASQDISNYLNWYQQKPGKAPKLLIYDASTLQSGVPSRFSGSGSGTDFTLTISSLQPE
DFATYYCQQSYSSHWTFGQGTKVEIK

Sorrento SH1E2 VH (SEQ ID NO: 30185)

EVQLVESGAEVKKPGSSVKVSCKASGGTFSSYAISWVRQAPGQGLEWMGGIIPIFGTANYAQKFQGRVTITADESTSTA
YMELSSLRSEDTAVYYCARAPYYYYYMDVWGQGTTVTVSS

Sorrento SH1E2 VL (SEQ ID NO: 30186)

QSALTQPASVSGSLGQSVTISCTGSSSDVGSYNLVSWYQQHPGKAPNLMIYDVSKRSGVSNRFSGSKSGNTASLTISGLQ
AEDEADYYCSSYTGISTVVFGGGTKLTVL

Sorrento SH1E4 VH (SEQ ID NO: 30187)

QVQLVQSGAEVKKPGSSVKVSCKASGGTFSRYGVHWVRQAPGQGLEWMGRLIPIVSMTNYAQKFQDRVSITTDKSTG
TAYMELRSLTSEDTALYYCASVGQQLPWVFFAWGQGTLVTVSS

Sorrento SH1E4 VL (SEQ ID NO: 30188)

QSVLTQPPSASGSPGQSVTISCTGTSSDIGGYDSVSWYQQHPGKAPKLMIYDVSKRPSGVSNRFSGSKSGNTASLTISGLQ
AEDEADYYCSSYTSSSIFFYVFGTGTKVTVL

Sorrento SH1B11 VH (SEQ ID NO: 30189)

QVQLVQSGSELKKPGSSVKVSCKASGYSFSGYYIHWVRQAPGQGLEWMGWIDPNSGVTNYVRRFQGRVTMTRDTSLS
TAYMELSGLTADDTAVYYCARDENLWQFGYLDYWGQGTLVTVSS

Sorrento SH1B11 VL (SEQ ID NO: 30190)

DIVMTQSPSSLSASIGDRVTITCRASQRISAYVNWYQQKPGKAPKVLIYAASSLRSGVPSRFSGSGSGTDFTLTISSLQPED
FATYYCQQTYSSPWTFGQGTKVEIK

Figure 78J

Sorrento SH1C8 VH (SEQ ID NO: 30191)

EVQLVESGGGVVQPGRSLRLSCAASGFTFSSYAMHWVRQAPGKGLEWVAVISYDGSNKYYADSVKGRFTISRDNSKN
TLYLQMNSLRAEDTAVYYCARGQWLVTELDYWGQGTLVTVSS

Sorrento SH1C8 VL (SEQ ID NO: 30192)

QSVVTQPPSVSAAPGQKVTISCSGSSSDIGNHYVSWYQQLPGTAPKLLIYDNNQRPSGIPDRFSGSKSGTSATLAITGLQT
GDEADYYCGTWDNSLSPHLLFGGGTKLTVL

Regeneron H1H9364P2 VH (SEQ ID NO: 30193)

EVQLVESGGGLVQPGRSLRLSCAASGFTFDDYALHWVRQAPGKGLEWVSGISWTGGTIDYADSVKGRFTISRDNAKNS
LYLQMSSLRTEDTAIYYCTRDIRGNWKYGGWFDPWGQGTLVTVSS

Regeneron H1H9364P2 VL (SEQ ID NO: 30194)

DIQMTQSPSSLSASVGDRVTITCRASQSISSYLNWYQQKPGKAPKLLIYAASSLQSGVPSRFSGSGSGTDFTLTISSLQPED
FATYYCQQSYSTPPITFGQGTRLEIK

Regeneron H1H9373P2 VH (SEQ ID NO: 30195)

QVQLVQSGTEVKKPGASVKVSCKASGYTFTAYYMHWVRQAPGQGLDWMGWISPNSGFTNYAQKFQGRVTMTRDTSI
NTFYMELSGLRSDDTAVYYCAREGSTHHNSFDPWGQGTLVTVSS

Regeneron H1H9373P2 VL (SEQ ID NO: 30196)

DIQMTQSPSSLSASVGDRVTITCRASQSISSYLNWYQQKPGKAPKLLIYAASSLQSGVPSRFSGSGSGTDFTLTISSLQPED
FATYYCQQSYSTPPITFGQGTRLEIK

Regeneron H1H8314N VH (SEQ ID NO: 30197)

EVQLVESGGGVVRPGGSLRLSCAASGFTFDDYGMTWVRQAPGRGLEWVSGIHWHGKRTGYADSVKGRFTISRDNAK
KSLYLQMNSLKGEDTALYHCVRGGMSTGDWFDPWGQGTLVIVSS

Regeneron H1H8314N VL (SEQ ID NO: 30198)

DIQMTQSPSSLSASLGDRVTITCRASQSINSYLNWYQQKPGKAPKLLIYVASSLQSGVPSRFSGSGSGTEFTLTISNLQPED
FATYYCQQSYSTPPITFGQGTRLEIK

Inserm PDL1.3.1 VH (SEQ ID NO: 30199)

EVQLQQSGTELVKPGASVKLSCTTSGFNIQDTYMHWVKQRPEQGLEWIGWIDPANGNTKYDPKFQGKATHADTSSNT
AYLQLRGLTSEDTAVYYCARSGVSTAHFDYWGQGTTLTVSS

Inserm PDL1.3.1 VL (SEQ ID NO: 30200)

QIVLSQSPAILSASPGEKVTMTCRASSSVSFMHWYQQKPGSSPKPWIYATSNLASGVPTRFSGSGSGTSYSLTLSRVEAE
DAATYYCQQWSSYPRTFGGGTKLEIK

Figure 79A additional CTLA-4 sequences

Medarex Ipilimumab VH (SEQ ID NO: 30201)

QVQLVESGGGVVQPGRSLRLSCAASGFTFSSYTMHWVRQAPGKGLEWVTFISYDGNNKYYADSVKGRFTISRDNSKNT
LYLQMNSLRAEDTAIYYCARTGWLGPFDYWGQGTLVTVSS

Medarex Ipilimumab VL (SEQ ID NO: 30202)

EIVLTQSPGTLSLSPGERATLSCRASQSVGSSYLAWYQQKPGQAPRLLIYGAFSRATGIPDRFSGSGSGTDFTLTISRLEPE
DFAVYYCQQYGSSPWTFGQGTKVEIK

Amgen/MedImmune/Pfizer Tremelimumab VH (SEQ ID NO: 30203)

QVQLVESGGGVVQPGRSLRLSCAASGFTFSSYGMHWVRQAPGKGLEWVAVIWYDGSNKYYADSVKGRFTISRDNSKN
TLYLQMNSLRAEDTAVYYCARDPRGATLYYYYYGMDVWGQGTTVTVSS

Amgen/MedImmune/Pfizer Tremelimumab VL (SEQ ID NO: 30204)

DIQMTQSPSSLSASVGDRVTITCRASQSINSYLDWYQQKPGKAPKLLIYAASSLQSGVPSRFSGSGSGTDFTLTISSLQPED
FATYYCQQYYSTPFTFGPGTKVEIK

Agenus AGEN1884 VH (SEQ ID NO: 30205)

EVQLVESGGGLVKPGGSLRLSCAASGFTFSSYSMNWVRQAPGKGLEWVSSISSSSSYIYYADSVKGRFTISRDNAKNSL
YLQMNSLRAEDTAVYYCARVGLMGPFDIWGQGTMVTVSS

Agenus AGEN1884 VL (SEQ ID NO: 30206)

EIVLTQSPGTLSLSPGERATLSCRASQSVSRYLGWYQQKPGQAPRLLIYGASTRATGIPDRFSGSGSGTDFTLTITRLEPED
FAVYYCQQYGSSPWTFGQGTKVEIK

Tegenero 4.3F6B5 VH (SEQ ID NO: 30207)

EVQLQPSGPVLVKPGASVKISCKASGYTFTDYKIHWVKQSHGKSLEWIGYIYPYSGSSDYNQKFKSKATLTVDNSSTTA
YMELRSLTSEDSAVYYCARGGDAMDYWGQGTAVTVSS

Tegenero 4.3F6B5 VL (SEQ ID NO: 30208)

DILMTQSPASLSASVGETVTITCGASENIYGALNWYQRKQGKSPQLLIYGATNLADGMSSRFSGSGLGRQYYLKISSLHP
DDVATYFCQNILGTWTFGGGTKLEIKR

Tegenero 4.8H10H5 VH (SEQ ID NO: 30209)

DVKLVESGGGLVKLGGSLKLSCAASGFTFNIYYMSWVRQTPEKRLELVAAINPDGGNTYYPDTVKGRFTISRDNAKNT
LYLQMSSLKSEDSALYYCARYGGPGFDSWGQGTTLTVSS

Tegenero 4.8H10H5 VL (SEQ ID NO: 30210)

ENVLTQSPAIMSASPGERVTMTCSASSSVSYMHWYQQKSNTSPKLWIYDTSKLASGVPGRFSGSGSRNSYSLTISSMEAE
DVATYYCFPGSGFPFMYTFGGGTKLEIKR

Tegenero TGN2122.C VH (SEQ ID NO: 30211)

QVQLVQSGAEVKKPGASVKVSCKASGYTFTDYKIHWVRQAPGQGLEWIGYIYPYSGSSDYNQKFKSRATLTVDNSIST
AYMELSRLRSDDTAVYYCARGGDAMDYWGQGTLVTVSS

Tegenero TGN2122.C VL (SEQ ID NO: 30212)

DIQMTQSPSSLSASVGDRVTITCGASENIYGALNWYQRKPGKAPKLLIYGATNLADGVPSRFSGSGSGRDYTLTISSLQP
EDFATYFCQNILGTWTFGGGTKVEIK

Figure 79B

Tegenero TGN2122.H VH (SEQ ID NO: 30213)

EVQLVESGGGLVQPGGSLRLSCAASGFTFNIYYMSWVRQAPGKGLELVAAINPDGGNTYYPDTVKGRFTISRDNAKNS
LYLQMNSLRAEDTAVYYCARYGGPGFDSWGQGTLVTVSS

Tegenero TGN2122.H VL (SEQ ID NO: 30214)

ENVLTQSPATLSLSPGERATLSCSASSSVSYMHWYQQKPGQAPRLWIYDTSKLASGIPARFSGSGSRNDYTLTISSLEPED
FAVYYCFPGSGFPFMYTFGGGTKVEIK

Sorrento F7 VH (SEQ ID NO: 30215)

QVQLVQSGAEVKKPGASVKVSCKASGYAFDGHYMHWVRQAPGQRLEWMGWVDPHSGATNYAQNFQGGVTMTRDT
SINTVYMELSSLKSDDTAVYYCARDFYDTSAKSGAFDIWGQGTMVTVSS

Sorrento F7 VL (SEQ ID NO: 30216)

AIQLTQSPSSVSASVGDRVTITCRASQGISSWLAWYQQKPGKAPKLLIYAASSLQSGVPSRFSGSGSGTDFTLTISSLQPED
FATYYCQQVNSFPWAFGQGTKVEIK

Sorrento E8 VH (SEQ ID NO: 30217)

QVQLVQSGAEVKKPGASVKVSCEASGYTFTNYYIHWLRQAPGQGLEWMGIINPSGGSTTYAQKFQGRITMTRDTSTNT
LYMELSSLRSEDTAIYYCARRDCRGPSCYFAYWGQGTTVTVSS

Sorrento E8 VL (SEQ ID NO: 30218)

DIVMTQSPSSLSASVGDRVTITCRASQSISSYLNWYQQKPGKAPKLLIYAASSLQSGVPPRFSGSGSGTEFTLTISSLQPED
FATYYCQQANSFPPTFGQGTKVDIK

Sorrento CT1E1 VH (SEQ ID NO: 30219)

EVQLVESGGGLVQPGRSLRLSCRGSNFNFDDLAISWVRQAPGKGLEWLGFVRSKAYGETTDYVASVKGRFTISRDDSK
FIAWLQMDSLKTDDTAVYYCTTFNYWGQGTLVTVSS

Sorrento CT1E1 VL (SEQ ID NO: 30220)

QPVLTQPPSVSVAPGKTARISCGGNNIASEAVHWYQKKPGQAPVLVIYYDSDRPSGIPERFSGSNSGNTATLRISRVDAG
DEADYYCQVWDRTTDQPVFGGGTKLTVL

Figure 80A additional LAG-3 sequences

Medarex BMS-986016 VH (SEQ ID NO: 30221)

QVQLQQWGAGLLKPSETLSLTCAVYGGSFSDYYWNWIRQPPGKGLEWIGEINHRGSTNSNPSLKSRVTLSLDTSKNQFS
LKLRSVTAADTAVYYCAFGYSDYEYNWFDPWGQGTLVTVSS

Medarex BMS-986016 VL (SEQ ID NO: 30222)

EIVLTQSPATLSLSPGERATLSCRASQSISSYLAWYQQKPGQAPRLLIYDASNRATGIPARFSGSGSGTDFTLTISSLEPEDF
AVYYCQQRSNWPLTFGQGTNLEIK

Immutep/INSERM/Novartis IMP731 VH (SEQ ID NO: 30223)

QVQLKESGPGLVAPSQSLSITCTVSGFSLTAYGVNWVRQPPGKGLEWLGMIWDDGSTDYNSALKSRLSISKDNSKSQVF
LKMNSLQTDDTARYYCAREGDVAFDYWGQGTTLTVSS

Immutep/INSERM/Novartis IMP731 VH (SEQ ID NO: 30224)

DIVMTQSPSSLAVSVGQKVTMSCKSSQSLLNGSNQKNYLAWYQQKPGQSPKLLVYFASTRDSGVPDRFIGSGSGTDFTL
TISSVQAEDLADYFCLQHFGTPPTFGGGTKLEIK

Immutep/INSERM/Novartis 13E2 VH (SEQ ID NO: 30225)

QVTLKESGPGILQPSQTLSLTCSFSGFSLSTSGMGLGWIRQPSGKGLEWLTHIWWDDIKRYNPDLRSRLTISKDTSSSQIFL
KIASVDTADTATYYCARIVEGSYSSSYFDVWGAGTTVTVSS

Immutep/INSERM/Novartis 13E2 VH (SEQ ID NO: 30226)

DIVMTQPHKFMSTSVEDRVTITCKASQDVIFDVAWYQQKPGQSPKLLIYSASSRVSGVPDRFTGSGSGTDFTFTISSVQA
EDLAVYYCQQHYSTPYTFGGGTTLEIK

Immutep/INSERM/Novartis 34F4 VH (SEQ ID NO: 30227)

QVTLKESGPGILQPSQTLSLTCSFSGFSLNTSGMGVGWIRQPSGKGLEWLTHIWWDDVKRYNPALKSRLTISKDTSSSQV
FLKIASVDTADTATYYCARIEGDTYYDYYFDYWGQGVTLTVSS

Immutep/INSERM/Novartis 34F4 VH (SEQ ID NO: 30228)

DIVMTQSHKLMSTSVGDGLSITCKASQDVSIAVVWYQQKPGQSPKLLIYSASFRYTGVPDRFTGSGSGTDFTFTISSVQA
EDLAVYYCQQHYSIPWTFGGGTKLEIK

Immutep/INSERM/Novartis IMP761 VH (SEQ ID NO: 30229)

QITLKESGPTLVKPTQTLTLTCTFSGFSLSTSGMGLGWIRQPPGKTLEWLTHIWWDDIKRYNPDLRSRLSITKDTSKNQV
VLTMTNMDPLDTGTYYCARIVEGSYSSSYFDVWGQGTLVTVSS

Immutep/INSERM/Novartis IMP761 VH (SEQ ID NO: 30230)

DIVMTQTPSSLSASVGDRVTITCKASQDVIFDVAWYQQRPGQAPKLLIYSASSRVSGVPSRFSGSGSGTDFTLTISSLQPE
DFATYYCQQHYSTPYTFGQGTRLDIK

GSK H5L7 VH (SEQ ID NO: 30231)

QVQLQESGPGLVKPSETLSLTCTVSGFSLTAYGVNWIRQPPGKGLEWIGMIWDDGSTDYDSALKSRVTISVDTSKNQFS
LKLSSVTAADTAVYYCAREGDVAFDYWGQGTLVTVSS

GSK H5L7 VL (SEQ ID NO: 30232)

DIQMTQSPSSLSASVGDRVTITCKSSQSLLNPSNQKNYLAWYQQKPGKAPKLLVYFASTRDSGVPSRFSGSGSGTDFTLT
ISSLQPEDFATYYCLQHFGTPPTFGQGTKLEIKR

Figure 80B

Merck hu22D2 VH (SEQ ID NO: 30233)

QMQLVQSGPEVKKPGTSVKVSCKASGYTFTDYNVDWVRQARGQRLEWIGDINPNNGGTIYAQKFQERVTITVDKSTST
AYMELSSLRSEDTAVYYCARNYRWFGAMDHWGQGTTVTVSS

Merck hu22D2 VL (SEQ ID NO: 30234)

DIVMTQTPLSLSVTPGQPASISCKASQSLDYEGDSDMNWYLQKPGQPPQLLIYGASNLESGVPDRFSGSGSGTDFTLKIS
RVEAEDVGVYYCQQSTEDPRTFGGGTKVEIK

Regeneron H4sH15482P VH (SEQ ID NO: 30235)

QVQLVESGGGVVQPGRSLRLSCVASGFTFSSYGMHWVRQAPGKGLEWVAIIWYDGSNKYYADSVKGRFTISRDNSKN
TQYLQMNSLRAEDTAVYYCASVATSGDFDYYGMDVWGQGTTVTVSS

Regeneron H4sH15482P VH (SEQ ID NO: 30236)

EIVLTQSPATLSLSPGERTTLSCRASQRISTYLAWYQQKPGQAPRLLIYDASKRATGIPARFSGSGSGTGFTLTISSLEPEDF
AVYYCQQRSNWPLTFGGGTKVEIK

Sorrento L35D4 VH (SEQ ID NO: 30237)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L35D4 VL (SEQ ID NO: 30238)

QSVLTQPPSASGSPGQSVTISCTGTSSDVGGYNYVSWYQQYPGKAPRLMIFEVTERASGVPDRFSGSKSGNTASLTVSGL
QTEDEAVYFCSSYSGSNNPGAMFGGGTKLTVL

Sorrento L35G6 VH (SEQ ID NO: 30239)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L35G6 VL (SEQ ID NO: 30240)

QAGLTQPASVSGSPGQSITISCTGSSSDVGGYSYVSWYQKHPGKAPKLMIYDVTNRPSGVSNRFSGSKSGNTASLTISGL
QAEDEADYYCSTYTRSNTLVFGPGTKVTVL

Sorrento L33H11 VH (SEQ ID NO: 30241)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L33H11 VL (SEQ ID NO: 30242)

LPVLTQPASVSGSPGQSITISCTGTSSDVGGYNYVSWYQQHPGKAPKLMIYDVTNRPSGVSNRFSGSKSGNTASLTISGL
QAEDEADYYCSSYTSSNTLLFGGGTQLTVL

Sorrento L32A9 VH (SEQ ID NO: 30243)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L32A9 VL (SEQ ID NO: 30244)

QSVVTQPPSVSAAPGQKVTISCSGSSSNIGNNYVSWYQQLPGTAPKLLIYDNNKRHSGIPDRFSGSTSDTSATLGITRLQT
GDEADYYCGTWDSSLSAYVFGTGTKVTVL

Figure 89C

Sorrento L32D10 VH (SEQ ID NO: 30245)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L32D10 VL (SEQ ID NO: 30246)

QSVLTQPPSASGSPGQSVTISCTGTSSDVGGYDYVSWYQQHQGKAPKLMIYDVSNRPSGVSNRFSGSKSGNTASLTISGL
QAEDEADYYCSSYTSSTTLVFGGGTKLTVL

Sorrento L32A4 VH (SEQ ID NO: 30247)

QVQLVQSGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L32A4 VL (SEQ ID NO: 30248)

QSVLTQPASVSGSPGQSITISCTGTSSDIGAYNFVSWYQQHPGKAPKLMIYGVSNRPSGVSSRFSGSKSGSTASLTISGLQ
AEDEADYYCSSYTTSGSAVFGTGTKLTVL

Sorrento L3A1 VH (SEQ ID NO: 30249)

EVQLLESGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L3A1 VL (SEQ ID NO: 30250)

QSVLTQPASVSGSPGQSITISCTGTSSDIGAYNFVSWYQQHPGKAPKLMIYGVSNRPSGVSSRFSGSKSGSTASLTITGLQ
AEDEADYYCSSYTTSGSAVFGTGTKLTVL

Sorrento L3A10 VH (SEQ ID NO: 30251)

EVQLLESGGGVVQPGRSLRVSCAASGFTFSNHAMHWVRQAPGKGLEWVAVISYDGSKKFYSDSVRGRFTISRDNSKNT
LYLQMNSLRPEDTAVYYCAKGAHGYTSGWHDYWGQGTLVTVSS

Sorrento L3A10 VL (SEQ ID NO: 30252)

DVVMTQSPSSLSASVGDRVSITCRASQNIGRYLNWYQQKPGKAPKLLVSAASSLQGGVPSRFSGSGSGTDFTLTISRLQP
EDFATYFCQQTYSSPQCTFGQGTKVDIK

Sorrento L3C5 VH (SEQ ID NO: 30253)

QVQLVQSGSELKKPGASVKVSCKASGYTFTNYYMHWVRQAPGQGLEWMGIINPSGGATNYAQKFQGRVTMTRDTST
STVYMELSSLRSEDTAVYYCARDSGYDLGYGMDVWGQGTLVTVSS

Sorrento L3C5 VL (SEQ ID NO: 30254)

QSVLTQPASVSGSPGQSITISCTGTSSDVGGYNYVSWYQQHPGKAPKLMIYDVSNRPSGASNRFSGSKSGNTASLTISGL
QAEDEADYYCSSYTNRNTLLFGGGTKLTVL

Sorrento L3E3 VH (SEQ ID NO: 30255)

EVQLLESGAEVKKPGASVKVSCKASGYTFTSYYMHWVRQAPGQGLEWMGIINPSAGSTSYAQKFQGRVTMTRDTSTS
TVYMELSSLRSEDTAVYYCARELMATGGFDYWGQGTLVTVSS

Sorrento L3E3 VL (SEQ ID NO: 30256)

QSVLTQPASASGSPGQSITISCTGTSSDVGGYNYVSWYQQHPGKAPKLMIYDVSNRPSGVSNRFSGSKSGNTASLTISGL
QAEDEANYYCSSYTSSSTNVFGTGTKVTVL

Figure 81A additional TIM-3 sequences

AnaptysBio/Tesaro APE5137 VH (SEQ ID NO: 30257)

EVQLLESGGGLVQPGGSLRLSCAAASGFTFSSYDMSWVRQAPGKGLDWVSTISGGGTYTYYQDSVKGRFTISRDNSKN
TLYLQMNSLRAEDTAVYYCASMDYWGQGTTVTVSSA

AnaptysBio/Tesaro APE5137 VL (SEQ ID NO: 30258)

DIQMTQSPSSLSASVGDRVTITCRASQSIRRYLNWYHQKPGKAPKLLIYGASTLQSGVPSRFSGSGSGTDFTLTISSLQPE
DFAVYYCQQSHSAPLTFGGGTKVEIKR

AnaptysBio/Tesaro APE5121 VH (SEQ ID NO: 30259)

EVQVLESGGGLVQPGGSLRLYCVASGFTFSGSYAMSWVRQAPGKGLEWVSAISGSGGSTYYADSVKGRFTISRDNSKN
TLYLQMNSLRAEDTAVYYCAKKYYVGPADYWGQGTLVTVSSG

AnaptysBio/Tesaro APE5121 VL (SEQ ID NO: 30260)

DIVMTQSPDSLAVSLGERATINCKSSQSVLYSSNNKNYLAWYQHKPGQPPKLLIYWASTRESGVPDRFSGSGSGTDFTL
TISSLQAEDVAVYYCQQYYSSPLTFGGGTKIEVK

Dana-Farber/Novartis ABTIM3-hum03 VH (SEQ ID NO: 30261)

QVQLVQSGAEVKKPGASVKVSCKASGYTFTSYNMHWVRQAPGQGLEWIGDIYPGQGDTSYNQKFKGRATMTADKST
STVYMELSSLRSEDTAVYYCARVGGAFPMDYWGQGTLVTVSS

Dana-Farber/Novartis ABTIM3-hum03 VL (SEQ ID NO: 30262)

DIVLTQSPDSLAVSLGERATINCRASESVEYYGTSLMQWYQQKPGQPPKLLIYAASNVESGVPDRFSGSGSGTDFTLTISS
LQAEDVAVYYCQQSRKDPSTFGGGTKVEIK

Dana-Farber/Novartis ABTIM3-hum11 VH (SEQ ID NO: 30263)

QVQLVQSGAEVKKPGSSVKVSCKASGYTFTSYNMHWVRQAPGQGLEWMGDIYPGNGDTSYNQKFKGRVTITADKST
STVYMELSSLRSEDTAVYYCARVGGAFPMDYWGQGTTVTVSS

Dana-Farber/Novartis ABTIM3-hum11 VL (SEQ ID NO: 30264)

AIQLTQSPSSLSASVGDRVTITCRASESVEYYGTSLMQWYQQKPGKAPKLLIYAASNVESGVPSRFSGSGSGTDFTLTISS
LQPEDFATYFCQQSRKDPSTFGGGTKVEIK

Dana-Farber/Novartis ABTIM3-hum21 VH (SEQ ID NO: 30265)

QVQLVQSGAEVKKPGASVKVSCKASGYTFTSYNMHWVRQAPGQGLEWIGDIYPGQGDTSYNQKFKGRATMTADKST
STVYMELSSLRSEDTAVYYCARVGGAFPMDYWGQGTLVTVSS

Dana-Farber/Novartis ABTIM3-hum21 VL (SEQ ID NO: 30266)

DIVLTQSPDSLAVSLGERATINCRASESVEYYGTSLMQWYQQKPGQPPKLLIYAASNVESGVPDRFSGSGSGTDFTLTISS
LQAEDVAVYYCQQSRKDPSTFGGGTKVEIK

KHK 4177 VH (SEQ ID NO: 30267)

QVQLQESGPGLVKPSETLSLTCTVSGGSISSYYWSWIRQPPGKGLEWIGYIFHSGSTNYNPSLKSRVTISVDTSKNQFSLK
LSSVTAADTAVYYCARDGEYFDMLTGFDYWGQGTLVTVSS

KHK 4177 VL (SEQ ID NO: 30268)

RCDIQMTQSPSSLSASVGDRVTITCRASQGISSWLAWYQQKPEKAPKSLIYAASSLQSGVPSRFSGSGSGTDFTLTISSLQP
EDFATYYCQQYNSYPRTFGQGTKVEIK

Figure 81B

KHK 4545 VH (SEQ ID NO: 30269)

QVQLQESGPGLVKPSETLSLTCTVSGGSFSRGGYYWNWIRQPPGKGLEWIGYIYYSGSTNYNPSLKSRVTISLDTSKNQF
SLKLSSVTAADTAVYYCARDHYSSSWTFDYWGQGTLVTVSS

KHK 4545 VL (SEQ ID NO: 30270)

EIVLTQSPATLSLSPGERATLSCRASQSVSSYLAWYQQKPGQAPRLLIYDASNRATGIPARFSGSGSGTDFTLTISSLEPED
FAVYYCQQRSNWPPTFGQGTKLEIK

KHK 8123 VH (SEQ ID NO: 30271)

QVQLVQSGAEVKKPGASVKVSCKASGYTFTSYWMHWVRQAPGQGLEWMGEINPSNGRTNYNEKFKTRVTITADTSTS
TAYMELSSLRSEDTAVYYCARGYYLYFDYWGQGTLVTVSS

KHK 8123 VL (SEQ ID NO: 30272)

DIQMTQSPSSLSASVGDRVTITCHASQGIRINIGWYQQKPGKAPKLLIYHGTNLEDGVPSRFSGSGSGTDFTLTISSLQPED
FATYYCVQYGQFPWTFGQGTKLEIK

Jounce mAb15 VH (SEQ ID NO: 30273)

QVQLKESGPGLVAPSQSLSITCTVSGFSLTGYGVTWVRQPPGKGLEWLGMIWGDGNTDYNSGLKSRLNISKDNSKSQV
FLKMNSLQTDDTARYYCARSYYYGPPDYWGQGTTLTVSS

Jounce mAb15 VL (SEQ ID NO: 30274)

DIVMTQSPSSLAMSVGQKVTMSCKSSQSLLNSRSQKNYLAWYQRKPGQSPKLLLYFASTRESGVPDRFIGSGSGTDFTL
TISSVQAEDLADYFCHQHYNTPYTFGGGTKLEIK

Jounce mAb58 VH (SEQ ID NO: 30275)

QIQLVQSGPELKKPGETVKISCKASGYTFTTYGMSWVKQAPGKGLKLMGWINTYSGAPTYADDFKGRFAFSLETSASA
AYLQINNLKNEDTATYFCARKPPHYYVNSFDYWGQGTTLTVSS

Jounce mAb58 VL (SEQ ID NO: 30276)

DIVMTQSPATLSVTPGDRVSLSCRASQSISDYLHWYQQKSHESPRLLIKYASQSISGIPSRFSGSGSGSDFTLSINSVEPEDV
GVYYCQNGHSFPYTFGGGTKLEIK

Roche TIM3-0433 VH (SEQ ID NO: 30277)

QITLKESGPTLVKPTQTLTLTCTFSGFSLSTSGMSVGWIRQPPGKGLEWLAHIWLNDDVFFNPALKSRLTITKDTSKNQV
VLTMTNMDPVDTATYYCVRANGYLYALDYWGQGTLVTVSS

Roche TIM3-0433 VH (SEQ ID NO: 30278)

ETTLTQSPAFMSATPGDKVNIACSASSSVSYTQWYQQKPGEAPKLWIYDAFKLAPGIPPRFSGSGYGTDFTLTINNIESED
AAYYFCHQWSSYPWTFGQGTKLEIK

Roche TIM3-0434 VH (SEQ ID NO: 30279)

QITLKESGPTLVKPTQTLTLTCTFSGFSLSTSGMSVGWIRQPPGKGLEWLAHIWLNDDVFFNPALKSRLTITKDTSKNQV
VLTMTNMDPVDTATYYCVRANGYLYALDYWGQGTLVTVSS

Roche TIM3-0434 VH (SEQ ID NO: 30280)

DIQLTQSPSFLSASVGDRVTITCSASSSVSYTQWYQQKPGKAPKLWIYDAFKLAPGVPSRFSGSGSGTEFTLTISSLQPEDF
ATYFCHQWSSYPWTFGQGTKLEIK

Figure 81C

Roche TIM3-0438 VH (SEQ ID NO: 30281)

EVQLVESGGGLVQPGGSLRLSCAASGFNIKTTYMHWVRQAPGKGLEWVGRIDPADDNTKYAPKFQGKATISADTSKN
TAYLQMNSLRAEDTAVYYCVRDFGYVAWFAYWGQGTLVTVSS

Roche TIM3-0438 VH (SEQ ID NO: 30282)

DIVMTQSPLSLPVTPGEPASISCRASQSVDNYVAWYLQKPGQSPQLLIYYASNRYIGVPDRFSGSGSGTDFTLKISRVEAE
DVGVYYCQQHYSSPYTFGQGTKVEIK

Roche TIM3-0443 VH (SEQ ID NO: 30283)

EVQLVESGGGLVQPGGSLRLSCAASGFNIKTTYMHWVRQAPGKGLEWVGRIDPADDNTKYAPKFQGKATISADTSKN
TAYLQMNSLRAEDTAVYYCVRDFGYVAWFAYWGQGTLVTFSS

Roche TIM3-0443 VH (SEQ ID NO: 30284)

DIVMTQSPLSLPVTPGEPASISCRASQSVDNYVAWYLQKPGQSPQLLIYYASNRYIGVPDRFSGSGSGTDFTLKISRVEAE
DVGVYYCQQHYSSPYTFGQGTKVEIK

Figure 82 additional BTLA sequences

Medarex 3C2 VH (SEQ ID NO: 30285)

QVQLQESGPGLVKPSETLSLTCTISGGSISNYYWNWIRQPPGKGLEWIGYIYYSTSTKYNPSLKSRVTMSVETSKNQFSL
KLSSVTAADTAVYYCARVKVYSTGWFFDYWGQGTLVTVSS

Medarex 3C2 VL (SEQ ID NO: 30286)

AIQLTQSPSSLSASVGDRVTITCRASQGISSALAWYQQKPGKAPKLLIYDASSLESGVPSRFSGSGSGTDFTLTISSLQPED
FATYYCQQFNSYPLTFGGGTKVEIK

Medarex 11E2 VH (SEQ ID NO: 30287)

EVQLVESGGGVIRPGGSLRLSCAASGFTFDDYGMSWVRQAPGKGLEWVSGINWNGGSTGYAASVKGRFTISRDNAKN
SLYLQMNSLRAEDSALYYCARDYYYGPGSPNYFYYAMDVWGQGTTVTVSS

Medarex 11E2 VL (SEQ ID NO: 30288)

DIQMTQSPSSLSASVGDRVTITCRASQGISSWLAWYQQKPEKAPKSLIYAASSLQSGVPSRFSGSGSGTDFTLTISSLQPED
FATYYCQQYNSYPRTFGQGTKVEIK

Medarex 4C7 VH (SEQ ID NO: 30289)

QVQLQESGPGLVKPSETLSLTCTVHGGSINHYYWSWIRQPPGKGLEWIGYIYYSGSTKYNPSLKSRVSISVDTSKNQFSL
KLTSVTAADTAVYYCAREWPYYYYEMDVWGQGTTVTVSS

Medarex 4C7 VL (SEQ ID NO: 30290)

EIVLTQSPGTLSLSPGERATLSCRASQSVSSSYLAWYQQKPGQAPRLLIYGASSRATGIPDRFSGSGSGTDFTLTISRLEPE
DFAVYYCQQYGSSFRTFGQGTKVEIK

Medarex 8D5 VH (SEQ ID NO: 30291)

EVQLVESGGGLVQPGGSLRLSCAASGFTISSYDMHWVRQATGKGLEWVSVIGPAGDTYYPGSVKGRFTISRENAKNSL
YLQMNSLRAGDTAVYYCAREGMAAHNYYGMDVWGQGTTVTVSS

Medarex 8D5 VL (SEQ ID NO: 30292)

EIVLTQSPATLSLSPGERATLSCRASQSVSSYLAWYQQKPGQAPRLLIYDASNRATGIPARFSGSGSGTDFTLTISSLEPED
FAVYYCQQRSNWPPITFGQGTRLEIK

Figure 83A additional TIGIT sequences

Genentech 10A7 VH (SEQ ID NO: 30293)

EVQLVESGGGLTQPGKSLKLSCEASGFTFSSFTMHWVRQSPGKGLEWVAFIRSGSGIVFYADAVRGRFTISRDNAKNLL
FLQMNDLKSEDTAMYYCARRPLGHNTFDSWGQGTLVTVSS

Genentech 10A7 VL (SEQ ID NO: 30294)

DIVMTQSPSSLAVSPGEKVTMTCKSSQSLYYSGVKENLLAWYQQKPGQSPKLLIYYASIRFTGVPDRFTGSGSGTDYTLT
ITSVQAEDMGQYFCQQGINNPLTFGDGTKLEIK

Genentech 1F4 VH (SEQ ID NO: 30295)

EVQLQQSGPELVKPGTSMKISCKASGYSFTGHLMNWVKQSHGKNLEWIGLIIPYNGGTSYNQKFKGKATLTVDKSSST
AYMELLSLTSDDSAVYFCSRGLRGFYAMDYWGQGTSVTVSS

Genentech 1F4 VL (SEQ ID NO: 30296)

DVVLTQTPLSLSVSFGDQVSISCRSSQSLVNSYGNTFLSWYLHKPGQSPQLLIFGISNRFSGVPDRFSGSGSGTDFTLKISTI
KPEDLGMYYCLQGTHQPPTFGPGTKLEVK

Genentech 4.1D3 VH (SEQ ID NO: 30297)

QVQLQQSGPGLVKPSQTLSLTCAISGDSVSSNSAAWNWIRQSPSRGLEWLGKTYYRFKWYSDYAVSVKGRITINPDTSK
NQFSLQLNSVTPEDTAVFYCTRESTTYDLLAGPFDYWGQGTLVTVSS

Genentech 4.1D3 VL (SEQ ID NO: 30298)

DIVMTQSPDSLAVSLGERATINCKSSQTVLYSSNNKKYLAWYQQKPGQPPNLLIYWASTRESGVPDRFSGSGSGTDFTL
TISSLQAEDVAVYYCQQYYSTPFTFGPGTKVEIK

Genentech 4.1D3.Q1E VH (SEQ ID NO: 30299)

EVQLQQSGPGLVKPSQTLSLTCAISGDSVSSNSAAWNWIRQSPSRGLEWLGKTYYRFKWYSDYAVSVKGRITINPDTSK
NQFSLQLNSVTPEDTAVFYCTRESTTYDLLAGPFDYWGQGTLVTVSS

Genentech 4.1D3.Q1E VL (SEQ ID NO: 30300)

DIVMTQSPDSLAVSLGERATINCKSSQTVLYSSNNKKYLAWYQQKPGQPPNLLIYWASTRESGVPDRFSGSGSGTDFTL
TISSLQAEDVAVYYCQQYYSTPFTFGPGTKVEIK

Merck MEB125.31C6.A1.205 VH4/VL1 VH (SEQ ID NO: 30301)

EVQLVQSGAEVKKPGASVKVSCKASGYTFSSYVMHWVRQAPGQGLEWIGYIDPYNDGAKYAQKFQGRVTLTSDKSTS
TVYMELSSLRSEDTAVYYCARGGPYGWYFDVWGQGTTVTVSS

Merck MEB125.31C6.A1.205 VH4/VL1 VL (SEQ ID NO: 30302)

DIQMTQSPSSLSASVGDRVTITCRASEHIYSYLSWYQQKPGKAPKLLIYNAKTLAEGVPSRFSGSGSGTDFTLTISSLQPE
DFATYYCQHHFGSPLTFGQGTRLEIK

Merck MEB125.31C6.A1.205 VH5/VL4 VH (SEQ ID NO: 30303)

EVQLVQSGAEVKKPGSSVKVSCKASGYTFSSYVMHWVRQAPGQGLEWIGYIDPYNDGAKYAQKFQGRVTLTSDKSTS
TAYMELSSLRSEDTAVYYCARGGPYGWYFDVWGQGTTVTVSS

Merck MEB125.31C6.A1.205 VH5/VL4 VL (SEQ ID NO: 30304)

DIQMTQSPSSLSASVGDRVTITCRASEHIYSYLSWYQQKPGKVPKLLIYNAKTLAEGVPSRFSGSGSGTQFTLTISSLQPE
DVATYYCQHHFGSPLTFGQGTRLEIK

Figure 83B

Merck MEB125.31C6.A1.205 VH5/VL3 VH (SEQ ID NO: 30305)

EVQLVQSGAEVKKPGSSVKVSCKASGYTFSSYVMHWVRQAPGQGLEWIGYIDPYNDGAKYAQKFQGRVTLTSDKSTS
TAYMELSSLRSEDTAVYYCARGGPYGWYFDVWGQGTTVTVSS

Merck MEB125.31C6.A1.205 VH5/VL3 VL (SEQ ID NO: 30306)

DIQMTQSPSSLSASVGDRVTITCRASEHIYSYLSWYQQKPGKVPKLLIYNAKTLAEGVPSRFSGSGSGTDFTLTISSLQPE
DVATYYCQHHFGSPLTFGQGTRLEIK

Merck Hu14D7 VH1 (SEQ ID NO: 30307)

EVQLVESGGGLVQPGGSLKLSCAASGFTFSGAWMDWVRQAPGKGLEWVAEIRTKVNNHATNYGESVKGRFTISRDDS
KSTVYLQMNSLRAEDTAVYYCRGALYDGFYFDYWGQGTLVTVSS

Merck Hu14D7 VH2 (SEQ ID NO: 30308)

EVQLVESGGGLVQPGGSLKLSCAASGFTFSGAWMDWVRQAPGKGLEWVAEIRTKVNNHATNYGESVKGRFTISRDDS
KSSVYLQMNSLRAEDTAVYYCRGALYDGFYFDYWGQGTLVTVSS

Merck Hu14D7 VH3 (SEQ ID NO: 30309)

EVQLVESGGGLVQPGGSLKLSCAASGFTFSGAWMDWVRQAPGKGLEWVAEIRTKVNNHATNYGESVKGRFTISRDDS
KNTVYLQMNSLRAEDTAVYYCRGALYDGFYFDYWGQGTLVTVSS

Merck Hu14D7 VL1 (SEQ ID NO: 30310)

EIVLTQSPATLSLSPGERATLSCSASSSVSSGYLYWYQQKPGQAPKLWIYGTSTLASGVPARFSGSGSGTDYTLTISSLEP
EDFAVYYCHQWSSFPYTFGQGTKLEIK

Merck Hu14D7 VL2 (SEQ ID NO: 30311)

EIVLTQSPATLSLSPGERATLSCSASSSVSSGYLYWYQQKPGQAPRLWIYGTSTLASGVPARFSGSGSGTDYTLTISSLEPE
DFAVYYCHQWSSFPYTFGQGTKLEIK

Merck Hu14D7 VL3 (SEQ ID NO: 30312)

EIVLTQSPATLSLSPGERATLSCSASSSVSSGYLYWYQQKPGQAPRLWIYGTSTLASGIPARFSGSGSGTDYTLTISSLEPE
DFAVYYCHQWSSFPYTFGQGTKLEIK

Merck Hu26B10 VH1 (SEQ ID NO: 30313)

EVQLVQSGAEVKKPGASVKISCKTSGYTFTEFTMHWVKQAPGKGLEWIGGLKPDNGGISYNQKFKGRATLTVDKSTNT
AYMELSSLRSEDTAVYYCARGAYYRYDADYWGQGTLVTVSS

Merck Hu26B10 VH2 (SEQ ID NO: 30314)

EVQLVQSGAEVKKPGASVKISCKTSGYTFTEFTMHWVRQAPGKGLEWIGGLKPDNGGISYNQKFKGRATLTVDKSTST
AYMELSSLRSEDTAVYYCARGAYYRYDADYWGQGTLVTVSS

Merck Hu26B10 VH3 (SEQ ID NO: 30315)

EVQLVQSGAEVKKPGASVKISCKVSGYTFTEFTMHWVRQAPGKGLEWIGGLKPDNGGISYNQKFKGRATLTVDTSTST
AYMELSSLRSEDTAVYYCARGAYYRYDADYWGQGTLVTVSS

Merck Hu26B10 VL1 (SEQ ID NO: 30316)

DIQLTQSPSSLSASVGDRVTITCKASQDVKTAVAWYQQKPGKAPKLLIYSASYRNTGVPDRFSGSGSGTDFTFTISSLQPE
DFATYYCQQHYSTPFTFGQGTKLEIK

Figure 83C

Merck Hu26B10 VL2 (SEQ ID NO: 30317)

DIQLTQSPSSLSASVGDRVTITCKASQDVKTAVAWYQQKPGKAPKLLIYSASYRNTGVPSRFSGSGSGTDFTFTISSLQPE
DFATYYCQQHYSTPFTFGQGTKLEIK

Merck Hu26B10 VL3 (SEQ ID NO: 30318)

DIQLTQSPSSLSASVGDRVTITCKASQDVKTAVAWYQQKPGKAPKLLIYSASYRNTGVPSRFSGSGSGTDFTLTISSLQPE
DFATYYCQQHYSTPFTFGQGTKLEIK

BMS 15A6 VH (SEQ ID NO: 30319)

QLQLQESGPGLVKPSETLSLTCTVSGGSISSSRYFWGWIRQPPGKGLEWIGYIYYRGSTYYNPSLKSRVTIAVDTSKNQFS
LKLSSVTAADTAVYYCASSSAWYFDYWGQGNLVTVSS

BMS 15A6 VL (SEQ ID NO: 30320)

EIVLTQSPGTLSLSPGERATLSCRASQSVSSSYLAWYQQKPGQAPRLLIYGASSRATGIPDRFSGSGSGTDFTLTISRLEPE
DFAVYYCQQYGSLYTFGQGTKLEIK

BMS 22G2 VH (SEQ ID NO: 30321)

QVHLQESGPGLVKPSETLSLTCTVSGGSVSSGIYYWSWIRQPPGKGLEWIGYIYYSGSTNYNPSLKSRVTISVDTSKNQFS
LKLSSVTAADTAVYYCARDYYVSGNYYNVDYYFFGVDVWGQGTTVTVSS

BMS 22G2 VL (SEQ ID NO: 30322)

EIVLTQSPATLSLSPGERATLSCRASQSVSSYLAWYQQKPGQAPRLLIYDASNRATGIPARFSGSGSGTDFTLTISSLEPED
FAVYYCQQRSNWPPLFTFGPGTKVDIK

BMS 11G11 VH (SEQ ID NO: 30323)

QLQLQESGPGLVKPSETLSLTCTVSGGSISSSSHYWGWIRQPPGKGLEWIGNIFYSGHTYYNPSLKSRVTISVDTSKNQFS
LKLSSVTAADTAVYYCARQGLLWFGGLSPYYFDYWGQGTLVTVSS

BMS 11G11 VL (SEQ ID NO: 30324)

EIVLTQSPATLSLSPGERATLSCRASQSVSSYLAWYQQKPGQAPRLLIYDASNRATGIPARFSGSGSGTDFTLTISSLEPED
FAVYYCQQRSNWPTFGQGTKLEIK

BMS 10D7 VH (SEQ ID NO: 30325)

QGQLVQSGAEVKKPGSSVKVSCKASGGIFRNYAISWVRQAPGQGLEWMGGIIPFFGTANYAQKFQGRVTITADESTSTA
YMELSSLRSEDTAVYYCARGGAAAGTTRYGYYYYGMDVWGQGTTVTVSS

BMS 10D7 VL (SEQ ID NO: 30326)

DIQMTQSPSSLSASVGDRVTITCRASQGISSWLAWYQQKPEKAPKSLIYAASSLQSGVPSRFSGSGSGTDFTLTISSLQPED
FATYYCQQYNSYPITFGQGTRLEIK

Oncomed 313R19 VH (SEQ ID NO: 30327)

QVQLQESGPGLVKPSETLSLTCTVSGFSLSSSYMSWIRQPPGKGLEWIGHGSNGNTYYANWAKGRVTISKSSNQVSLKL
SSVTAADTAVYYCARGGYRTSGMDPWGQGTLVTVSS

Oncomed 313R19 VL (SEQ ID NO: 30328)

DIQMTQSPSSLSASVGDRVTITCQASQNIYSDLAWYQQKPGKAPKLLIYRASTLASGVPSRFSGSGSGTDFTLTISSLQPE
DFATYYCQQEHLVAWIYNVFGQGTKVEIKR

Figure 83D

Oncomed 313M32 VH (SEQ ID NO: 30329)

QVQLQESGPGLVKPSETLSLTCAVSGYSITSDYAWNWIRQPPGKGLEWIGYISYSGSTSYNPSLRSRVTISRDTSKNQFFL
KLSSVTAADTAVYYCARRQVGLGFAYWGQGTLVTVSS

Oncomed 313M32 VL (SEQ ID NO: 30330)

DIQMTQSPSSLSASVGDRVTITCKASQDVSTAVAWYQQKPGKAPKLLIYSASYRYTGVPSRFSGSGSGTDFTFTISSLQPE
DIATYYCQQHYSTPWTFG

Figure 84A (anti BTLA4 variable heavy and light chains + CDRs)

| What: anti-BTLA XENP20269 9C6_H0L0 | sequence | SEQ ID NO: |
|---|---|---|
| Variable heavy (vh) domain | QVQLKESGPGLVAPSQSLSITCTVSGFSLIGYGVNWVRQPPGKGLEWLGMIWIDGSTDYNSALKSRLSIN KDNSKSQVFLKMNSLQTDDTARYYCARDRPDGRAMDYWGQGTSVTVSS | 30331 |
| vhCDR1 | GYGVN | 30332 |
| vhCDR2 | MIWIDGSTDYNSALKS | 30333 |
| vhCDR3 | DRPDGRAMDY | 30334 |
| Variable light (vl) domain | SIVMTQTPKFLLVSAGDRVTITCKASQSVSNDVAWYQQKPGQSPKLLIYYASNRYTGVPDRFTGSGYGTD FTFTISTVQAEDLAVYFCQQDYSSPTFGGGTKLEIK | 30335 |
| vlCDR1 | KASQSVSNDVA | 30336 |
| vlCDR2 | YASNRYT | 30337 |
| vlCDR3 | QQDYSSPT | 30338 |

Figure 84B

| What: anti-BTLA XENP20872 9C6_H1.1L1 | sequence | SEQ ID NO: |
|---|---|---|
| Variable heavy (vh) domain | QVQLKESGAEVKKPGASVKVSCKVSGFSLTGYGVNWVRQAPGQGLEWMGMIWIDGSTDYNSKFQGRVTMT KDNSKSTVYMELSSLRSEDTAVYYCARDRPDGRAMDYWGQGTMVTVSS | 30339 |
| vhCDR1 | GYGVN | 30340 |
| vhCDR2 | MIWIDGSTDYNSKFQG | 30341 |
| vhCDR3 | DRPDGRAMDY | 30342 |
| Variable light (vl) domain | SIVMTQSPDSLAVSLGERATINCKASQSVSNDVAWYQQKPGQSPKLLIYYASNRYTGVPDRFTGSGYGTD FTLTISSLQAEDVAVYFCQQDYSSPTFGGGTKLEIK | 30343 |
| vlCDR1 | KASQSVSNDVA | 30344 |
| vlCDR2 | YASNRYT | 30345 |
| vlCDR3 | QQDYSSPT | 30346 |

Figure 84C (anti BTLA variable heavy and light chains + CDRs)

| What: anti-BTLA XENP020882 9C6_H1.1L1 | sequence | SEQ ID NO: |
|---|---|---|
| Variable heavy (vh) domain | QVQLVQSGAEVKKPGASVKVSCKVSGFSLTGYGVNWVRQAPGQGLEWMGMIWIDGSTDYNSKFQGRLSIN KDNSKSTVYMELSSLRSEDTAVYYCARDRPDGRAMDYWGQGTMVTVSS | 30347 |
| vhCDR1 | GYGVN | 30348 |
| vhCDR2 | MIWIDGSTDYNSKFQG | 30349 |
| vhCDR3 | DRPDGRAMDY | 30350 |
| Variable light (vl) domain | SIVMTQSPDSLAVSLGERATINCKASQSVSNDVAWYQQKPGQSPKLLIYYASNRYTGVPDRFTGSGYGTD FTLTISSLQAEDVAVYFCQQDYSSPTFGGGTKLEIK | 30351 |
| vlCDR1 | KASQSVSNDVA | 30352 |
| vlCDR2 | YASNRYT | 30353 |
| vlCDR3 | QQDYSSPT | 30354 |

Figure 85

| 1st/2nd antigens | PD-1 | PD-L1 | CTLA-4 | LAG-3 | TIM-3 | BTLA | TIGIT |
|---|---|---|---|---|---|---|---|
| ICOS | A, B, C, H, I | B, H, I | B, D, E, H, I | B, F, H, I | B, H, I | B, G, H, I | B, H, I |
| GITR | A, C, H, I | H, I | D, E, H, I | F, H, I | H, I | G, H, I | H, I |
| OX40 | A, C, H, I | H, I | D, E, H, I | F, H, I | H, I | G, H, I | H, I |
| 4-1BB | A, C, H, I | H, I | D, E, H, I | F, H, I | H, I | G, H, I | H, I |

Figure 86

XENP22917

\>XENP022917 [ICOS]_H0_L0.38_Fab-1G6_L1.194_H1.279 Fab-Fc Heavy Chain (SEQ ID NO: 30355)
QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVLHEALHSHYTQKSLSLSPGK \>XENP022917 [ICOS]_H0_L0.38_Fab-1G6_L1.194_H1.279 scFv-Fc Heavy Chain (SEQ ID NO: 30356)
EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK \>XENP022917 [ICOS]_H0_L0.38_Fab-1G6_L1.194_H1.279 Light Chain (SEQ ID NO: 30357)
DIQMTQSPSSVSASVGDRVTITCQASQDISSLLAWYQQKPGKAPKLLIYAASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

XENP22977

\>XENP022977 [ICOS]_H0_L0.37_Fab-1G6_L1.194_H1.279 Fab-Fc Heavy Chain (SEQ ID NO: 30358)
QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVLHEALHSHYTQKSLSLSPGK \>XENP022977 [ICOS]_H0_L0.37_Fab-1G6_L1.194_H1.279 scFv-Fc Heavy Chain (SEQ ID NO: 30359)
EIVLTQSPATLSASPGERVTLTCRASQSVGNDVAWYQQKPGQAPRLLINYASHRYTGVPDRFTGSGYGTEFTLTISSVQSED
FGVYYCQQDFSSPRTFGGGTKVEIK/GKPGSGKPGSGKPGSGKPGS/EVQLVESGGGLVKPGGSLRLSCVASGFTFSNYWMN
WVRQAPGKGLEWVAEIRLYSNNYATHYAESVKGRFTISRDDSKSTLYLQMNNLKTEDTGVYYCTRYYGNYGGYFDVWGRGTL
VTVSS/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK \>XENP022977 [ICOS]_H0_L0.37_Fab-1G6_L1.194_H1.279 Light Chain (SEQ ID NO: 30360)
DIQMTQSPSSVSASVGDRVTITCQASQDISRLLAWYQQKPGKAPKLLIYAASSLQSGVPSRFSGSGSGTDFTLTISSLQPED
FATYYCQQAESFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

Figure 96

**>XENP024901[ICOS] H0.66 L0 Fab-empty Fc(216) IgG1 PVA /S267K pI(-
) Isosteric A L368D/K370S/M428L/N434S-IgG1 C220S/S364K/E357Q/M428L/N434SXXX**

*XENP024901[ICOS]_H0.66_L0_Fab_IgG1_PVA_/S267K_pI(-
)_Isosteric_A_L368D/K370S/M428L/N434S Fab-Fc Heavy Chain* (SEQ ID NO: 30361)
QVQLVQSGAEVKKPGASVKVSCKASGYTFTGYYMHWVRQAPGQGLEWMGWINPRSGETIYAQKFQGRVTMTRDTSIS
TAYMELSSLRSEDTAVYYCARTYYYDTSGYYRDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

*XENP024901 empty_Fc(216)_IgG1_C220S/S364K/E357Q/M428L/N434S empty-Fc Heavy
Chain* (SEQ ID NO: 30362)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK

*XENP024901[ICOS]_ L0 Light Chain* (SEQ ID NO: 30363)
DIQMTQSPSSVSASVGDRVTITCRASQGISRLLAWYQQKPGKAPKLLIYAASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 97

A) XENP016470 huPD-L1 Fc(216) huIgG1-mIgG2aa Hinge(KasI) mIgG2aa CH2 CH3 (SEQ
ID NO: 30364)
FTVTVPKDLYVVEYGSNMTIECKFPVEKQLDLAALIVYWEMEDKNIIQFVHGEEDLKVQHSSYRQRARLLKDQLSLG
NAALQITDVKLQDAGVYRCMISYGGADYKRITVKVNAPYNKINQRILVVDPVTSEHELTCQAEGYPKAEVIWTSSDH
QVLSGKTTTTNSKREEKLFNVTSTLRINTTTNEIFYCTFRRLDPEENHTAELVIPELPLAHPPNER/EPKSSDKTHT
CPPCPAPNLLGGPSVFIFPPKIKDVLMISLSPMVTCVVVDVSEDDPDVQISWFVNNVEVLTAQTQTHREDYNSTLRV
VSALPIQHQDWMSGKEFKCKVNNKALPAPIERTISKPKGSVRAPQVYVLPPPEEEMTKKQVTLTCMVTDFMPEDIYV
EWTNNGKTELNYKNTEPVLDSDGSYFMYSKLRVEKKNWVERNSYSCSVVHEGLHNHHTTKSFSRTPGK

B) XENP017869 huPD-L2 Fc(216) huIgG1-mIgG2aa Hinge(KasI) mIgG2aa CH2 CH3 (SEQ
ID NO: 30365)
LFTVTVPKELYIIEHGSNVTLECNFDTGSHVNLGAITASLQKVENDTSPHRERATLLEEQLPLGKASFHIPQVQVRD
EGQYQCIIIYGVAWDYKYLTLKVKASYRKINTHILKVPETDEVELTCQATGYPLAEVSWPNVSVPANTSHSRTPEGL
YQVTSVLRLKPPPGRNFSCVFWNTHVRELTLASIDLQSQMEPRTHPT/EPKSSDKTHTCPPCPAPNLLGGPSVFIFP
PKIKDVLMISLSPMVTCVVVDVSEDDPDVQISWFVNNVEVLTAQTQTHREDYNSTLRVVSALPIQHQDWMSGKEFKC
KVNNKALPAPIERTISKPKGSVRAPQVYVLPPPEEEMTKKQVTLTCMVTDFMPEDIYVEWTNNGKTELNYKNTEPVL
DSDGSYFMYSKLRVEKKNWVERNSYSCSVVHEGLHNHHTTKSFSRTPGK — XmAb23104 (EC$_{80}$: 0.9 μg/mL; EC$_{50}$: 0.1 μg/mL; EC$_{20}$: 0.1 μg/mL)
▲ XENP20111 (EC$_{80}$: 0.9 μg/mL; EC$_{50}$: 1.9 μg/mL; EC$_{20}$: 3.9 μg/mL)
● XENP16432 (EC$_{80}$: 0.2 μg/mL; EC$_{50}$: 0.1 μg/mL; EC$_{20}$: 0.05 μg/mL)
■ XENP24901

— XmAb23104 (EC$_{80}$: 0.3 μg/mL; EC$_{50}$: 0.1 μg/mL; EC$_{20}$: 0.01 μg/mL)
▲ XENP20111 (EC$_{80}$: 0.6 μg/mL; EC$_{50}$: 1.5 μg/mL; EC$_{20}$: 3.4 μg/mL)
● XENP16432 (EC$_{80}$: 0.2 μg/mL; EC$_{50}$: 0.1 μg/mL; EC$_{20}$: 0.06 μg/mL)
■ XENP24901

Figure 99

>XENP023642 huICOSL Fc(216) IgG1 C220S/PVA /S267K (SEQ ID NO: 30366)
DTQEKEVRAMVGSDVELSCACPEGSRFDLNDVYVYWQTSESKTVVTYHIPQNSSLENVDSRYRNRALMSPAGMLRGD
FSLRLFNVTPQDEQKFHCLVLSQSLGFQEVLSVEVTLHVAANFSVPVVSAPHSPSQDELTFTCTSINGYPRPNVYWI
NKTDNSLLDQALQNDTVFLNMRGLYDVVSVLRIARTPSVNIGCCIENVLLQQNLTVGSQTGNDIGERDKITENPVST
GEKNAAT/EPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNHYTQK
SLSLSPGK

Figure 100

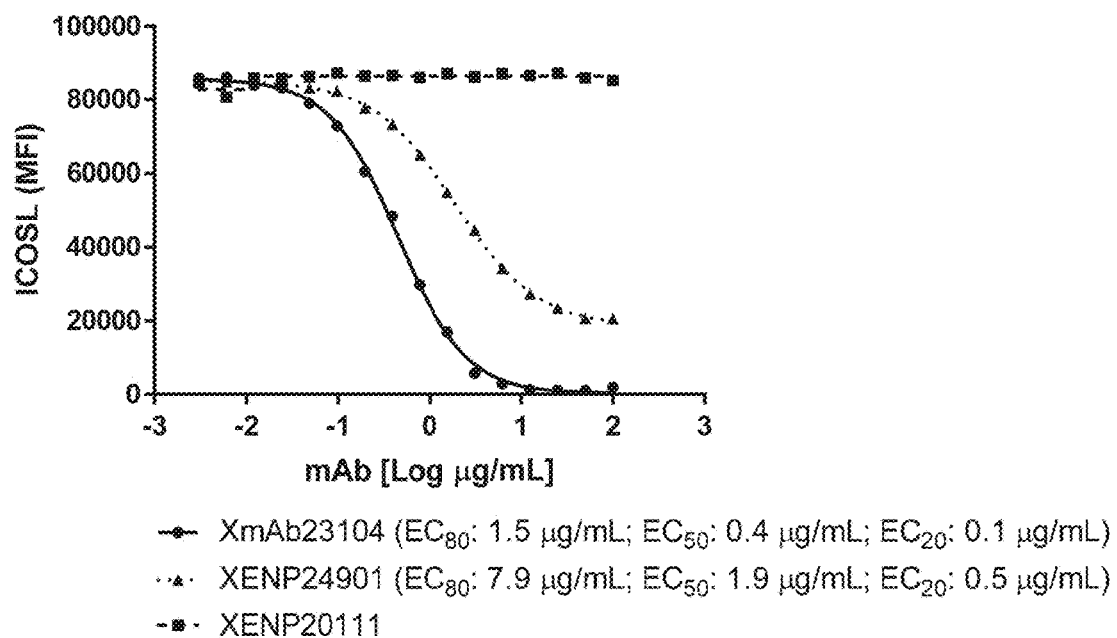

→ XmAb23104 (EC$_{80}$: 1.5 µg/mL; EC$_{50}$: 0.4 µg/mL; EC$_{20}$: 0.1 µg/mL)
⋯▲⋯ XENP24901 (EC$_{80}$: 7.9 µg/mL; EC$_{50}$: 1.9 µg/mL; EC$_{20}$: 0.5 µg/mL)
-■- XENP20111

Figure 104

>XENP021622 empty-Fc(216) 1G6_L1.194_H1.279_scFv(GKPGS)4-IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP021622 empty-Fc(216)_pI(-
)_Isosteric_A_C220S/PVA_/S267K/L368D/K370S/M428L/N434S empty-Fc Heavy Chain
(SEQ ID NO: 30367)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK XENP021622
1G6_L1.194_H1.279_scFv(GKPGS)4_IgG1_C220S/PVA_/S267K/S364K/E357Q/M428L/N434S
scFv-Fc Heavy Chain (SEQ ID NO: 30368)
EIVLTQSPATLSASPGERVTLTCRASQSVGNDVAWYQQKPGQAPRLLINYASHRYTGVPDRFTGSGYGTEFTLTISS
VQSEDFGVYYCQQDFSSPRTFGGGTKVEIK/GKPGSGKPGSGKPGSGKPGS/EVQLVESGGGLVKPGGSLRLSCVAS
GFTFSNYWMNWVRQAPGKGLEWVAEIRLYSNNYATHYAESVKGRFTISRDDSKSTLYLQMNNLKTEDTGVYYCTRYY
GNYGGYFDVWGRGTLVTVSS/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Figure 105

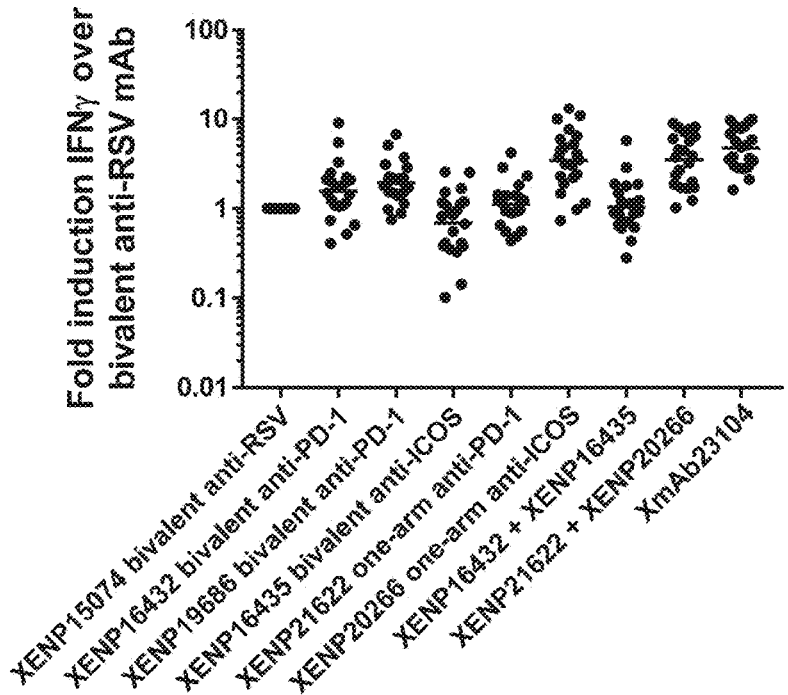

Figure 108

>XENP016433 Ipilimumab H0L0 IgG1 PVA /S267K

*XENP016433 Ipilimumab_H0L0_IgG1_PVA_/S267K Heavy Chain* (SEQ ID NO: 30369)
QVQLVESGGGVVQPGRSLRLSCAASGFTFSSYTMHWVRQAPGKGLEWVTFISYDGNNKYYADSVKGRFTISRDNSKN
TLYLQMNSLRAEDTAIYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPC
PAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGK

*XENP016433 Ipilimumab_H0L0_IgG1_PVA_/S267K Light Chain* (SEQ ID NO: 30370)
EIVLTQSPGTLSLSPGERATLSCRASQSVGSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

Figure 117

>XENP020053 [αCTLA-4]_H3L0.22-1G6_L1.194_H1.279 Fab-Fc Heavy Chain (SEQ ID NO: 30371)
EVQLVESGGGLVKPGGSLRLSCAASGFTFSSYTMHWVRQAPGKGLEWVSFISYDGNNK
YYADSVKGRFTISRDNAKNSLYLQMNSLRAEDTAVYYCARTGWLGPFDYWGQGTLVT
VSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPR
EEEYNSTYRVVSVLTVLHQDWLNGKEYKCKVSNKALPAPIEKTISKAKGQPREPQVYTL
PPSREEMTKNQVSLTCDVSGFYPSDIAVEWESDGQPENNYKTTPPVLDSDGSFFLYSKLT
VDKSRWEQGDVFSCSVMHEALHNHYTQKSLSLSPGK >XENP020053 [αCTLA-4]_H3L0.22-1G6_L1.194_H1.279 scFv-Fc Heavy Chain (SEQ ID NO: 30372)
EIVLTQSPATLSASPGERVTLTCRASQSVGNDVAWYQQKPGQAPRLLINYASHRYTGVP
DRFTGSGYGTEFTLTISSVQSEDFGVYYCQQDFSSPRTFGGGTKVEIK/GKPGSGKPGSGK
PGSGKPGS/EVQLVESGGGLVKPGGSLRLSCVASGFTFSNYWMNWVRQAPGKGLEWVA
EIRLYSNNYATHYAESVKGRFTISRDDSKSTLYLQMNNLKTEDTGVYYCTRYYGNYGG
YFDVWGRGTLVTVSS/EPKSSDKTHTCPPCPAPPVAGPSVFLFPPKPKDTLMISRTPEVTC
VVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHN
HYTQKSLSLSPGK >XENP020053 [αCTLA-4]_H3L0.22-1G6_L1.194_H1.279 Light Chain (SEQ ID NO: 30373)
EIVLTQSPGTLSLSPGERATLSCRASQSVSSSYLAWYQQKPGQAPRLLIYGAFSRATGIPD
RFSGSGSGTDFTLTISRLEPEDFAVYYCQQYGSSPWTFGQGTKVEIK/RTVAAPSVFIFPPS
DEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 120

>XENP29154_TGN1412_hu5.11A1[CD28]_H1L1_IgG4_K447del

XENP29154_TGN1412_hu5.11A1[CD28]_H1_IgG4_K447del Heavy Chain (SEQ ID NO: 30374)

EVQLVESGGGLVQPGGSLRLSCAASGFTFSDSWIHWVRQAPGKGLEWVAWISPYGGSTYYA
DSVKGRFTISADTSKNTAYLQMNSLRAEDTAVYYCARRHWPGGFDYWGQGTLVTVSS/ASTK
GPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPPVAGPSVFLFPPKPK
DTLMISRTPEVTCVVVDVKHEDPEVKFNWYVDGVEVHNAKTKPREEQYNSTYRVVSVLTVLHQ
DWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHY
TQKSLSLSPGK

XENP29154 TGN1412_hu5.11A1[CD28]_ L1 Light Chain (SEQ ID NO: 30375)

DIQMTQSPSSLSASVGDRVTITCRASQDVSTAVAWYQQKPGKAPKLLIYSASFLYSGVPSRFS
GSGSGTDFTLTISSLQPEDFATYYCQQYLYHPATFGQGTKVEIK/RTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 124

| XmAb23104 Binding Partner | Human | | | Cynomolgus Monkey | | |
|---|---|---|---|---|---|---|
| | $K_D$ (M) | $k_a$ (1/Ms) | $k_d$ (1/s) | $K_D$ (M) | $k_a$ (1/Ms) | $k_d$ (1/s) |
| PD-1 | $2.8 \times 10^{-9}$ | $2.4 \times 10^{5}$ | $6.8 \times 10^{-4}$ | $5.8 \times 10^{-9}$ | $2.1 \times 10^{5}$ | $1.2 \times 10^{-3}$ |
| ICOS | $2.9 \times 10^{-9}$ | $6.6 \times 10^{4}$ | $1.9 \times 10^{-4}$ | $2.6 \times 10^{-9}$ | $6.6 \times 10^{4}$ | $1.7 \times 10^{-4}$ |

| Receptor | $K_D$ (M) | |
|---|---|---|
| | XmAb23104 | XENP20896 |
| Human FcRn | $1.5 \times 10^{-7}$ | $2.6 \times 10^{-6}$ |
| Cynomolgus Monkey FcRn | $9.1 \times 10^{-8}$ | $1.6 \times 10^{-6}$ to $5.5 \times 10^{-7a}$ |
| Mouse FcRn | $5.6 \times 10^{-8}$ | $1.6 \times 10^{-7}$ |

Figure 138

> XENP23058_Jounce_37A10S713_[ICOS]_H0L0_IgG1_WT Heavy Chain (SEQ ID NO: 30376)

EVQLVESGGGLVQPGGSLRLSCAASGFTFSDYWMDWVRQAPGKGLVWVSNIDEDG
SITEYSPFVKGRFTISRDNAKNTLYLQMNSLRAEDTAVYYCTRWGRFGFDSWGQGTL
VTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPP
CPAPELLGGPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK

> XENP23058_Jounce_37A10S713_[ICOS]_H0L0_IgG1_WT Light Chain (SEQ ID NO: 30377)

DIVMTQSPDSLAVSLGERATINCKSSQSLLSGSFNYLTWYQQKPGQPPKLLIFYASTRH
TGVPDRFSGSGSGTDFTLTISSLQAEDVAVYYCHHHYNAPPTFGPGTKVDIKRTVAAP
SVFIFPPSDEQLKSGTASVVCLLNNFYPREAKVQWKVDNALQSGNSQESVTEQDSKD
STYSLSSTLTLSKADYEKHKVYACEVTHQGLSSPVTKSFNRGEC

Figure 139

> XENP23057_Jounce_37A10S713_[ICOS]_H0L0_IgG1_PVA_/S267K Heavy Chain
(SEQ ID NO: 30378)

EVQLVESGGGLVQPGGSLRLSCAASGFTFSDYWMDWVRQAPGKGLVWVSNIDEDG
SITEYSPFVKGRFTISRDNAKNTLYLQMNSLRAEDTAVYYCTRWGRFGFDSWGQGTL
VTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK

> XENP23057_Jounce_37A10S713_[ICOS]_H0L0_IgG1_PVA_/S267K Light Chain
(SEQ ID NO: 30379)

DIVMTQSPDSLAVSLGERATINCKSSQSLLSGSFNYLTWYQQKPGQPPKLLIFYASTRH
TGVPDRFSGSGSGTDFTLTISSLQAEDVAVYYCHHHYNAPPTFGPGTKVDIKRTVAAP
SVFIFPPSDEQLKSGTASVVCLLNNFYPREAKVQWKVDNALQSGNSQESVTEQDSKD
STYSLSSTLTLSKADYEKHKVYACEVTHQGLSSPVTKSFNRGEC

US 10,981,992 B2

BISPECIFIC IMMUNOMODULATORY ANTIBODIES THAT BIND COSTIMULATORY AND CHECKPOINT RECEPTORS

PRIORITY CLAIM

This application claims priority to U.S. Patent Application Nos. 62/583,431, filed Nov. 8, 2017; 62/614,271, filed Jan. 5, 2018; 62/640,468, filed Mar. 8, 2018; 62/683,554, filed Jun. 11, 2018 and 62/724,502; filed Aug. 29, 2018, all of which are expressly incorporated herein by reference in their entirety, with particular reference to the figures, legends, and claims therein.

SEQUENCE LISTING

The instant application contains a Sequence Listing which has been submitted electronically in ASCII format and is hereby incorporated by reference in its entirety. Said ASCII copy, created on Nov. 8, 2017 and amended on May 22, 2019, is named 067461-5216-US_SL.txt and is 28,257,248 kilobytes in size.

BACKGROUND OF THE INVENTION

Tumor-reactive T cells lose their cytotoxic ability over time due to up-regulation of inhibitory immune checkpoints such as PD-1 and CTLA-4. Two parallel therapeutic strategies are being pursued for de-repressing tumor-reactive T cells so that they can continue to kill tumor cells.

The first approach is immune immunomodulatory blockade by treating with antagonistic monoclonal antibodies that bind to either the immunomodulatory itself (PD-1, CTLA-4, etc.) or its ligand (PD-L1, PD-L2, CD80, CD86, etc.), thus removing the inhibitory signals holding back tumor-reactive T cells from tumor cell killing. Immunomodulatory receptors such as CTLA-1, PD-1 (programmed cell death 1), TIM-3 (T cell immunoglobulin and mucin domain 3), LAG-3 (lymphocyte-activation gene 3), TIGIT (T cell immunoreceptor with Ig and ITIM domains), and others, inhibit the activation, proliferation, and/or effector activities of T cells and other cell types. Guided by the hypothesis that immunomodulatory receptors suppress the endogenous T cell response against tumor cells, preclinical and clinical studies of anti-CTLA4 and anti-PD1 antibodies, including nivolumab, pembrolizumab, ipilimumab, and tremelimumab, have indeed demonstrated that immunomodulatory blockade results in impressive anti-tumor responses, stimulating endogenous T cells to attack tumor cells, leading to long-term cancer remissions in a fraction of patients with a variety of malignancies. Unfortunately, only a subset of patients responds these therapies, with response rates generally ranging from 10 to 30% and sometimes higher for each monotherapy, depending on the indication and other factors.

The second approach for de-repressing tumor-reactive T cells is T cell costimulation by treating with agonistic antibodies that bind to costimulatory proteins such as ICOS, thus adding a positive signal to overcome the negative signaling of the immune checkpoints.

Accordingly, the invention is directed to bispecific antibodies that bind to costimulatory receptors (e.g. ICOS, GITR, OX40, 4-1BB) as well as checkpoint receptors (e.g. PD-1, PD-L1, CTLA-4, LAG-3, TIM-3, BTLA and TIGIT.

SUMMARY OF THE INVENTION

Accordingly, in one aspect, the invention provides bispecific antibodies that monovalently binds a human costimulatory receptor and monovalently binds a human checkpoint receptor for use in activating T cells for the treatment of cancer.

In some aspects, the costimulatory receptor is selected from the group consisting of ICOS, GITR, OX40 and 4-1BB.

In additional aspects, the checkpoint receptor is selected from the group consisting of PD-1, PD-L1, CTLA-4, LAG-3, TIGIT and TIM-3.

In further aspects, the antibody binds an antigen pair selected from: ICOS and PD-1, ICOS and CTLA-4, ICOS and LAG-3, ICOS and TIM-3, ICOS and PD-L1, ICOS and BTLA, ICOS and TIGIT, GITR and TIGIT, GITR and PD-1, GITR and CTLA-4, GITR and LAG-3, GITR and TIM-3, GITR and PD-L1, GITR and BTLA, OX40 and PD-1, OX40 and TIGIT, OX40 and CTLA-4, IC OX40 OS and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1, TIGIT and 4-1BB and 4-1BB and BTLA.

In additional aspects, the bispecific antibody has a format selected from those outlined in FIG. 2.

In further aspects, the invention provides heterodimeric antibodies comprising: a) a first heavy chain comprising a first Fc domain, an optional domain linker and a first antigen binding domain comprising an scFv that binds a first antigen; b) a second heavy chain comprising a heavy chain comprising a heavy chain constant domain comprising a second Fc domain, a hinge domain, a CH1 domain and a variable heavy domain; and c) a light chain comprising a variable light domain and a light chain constant domain; wherein said variable heavy domain and said variable light domain form a second antigen binding domain that binds a second antigen, wherein one of said first and second antigen binding domains binds human ICOS and the other binds human PD-1.

In an additional aspect, the invention provides heterodimeric bispecific antibodies comprising: a) a first heavy chain comprising: i) a first variant Fc domain; and ii) a single chain Fv region (scFv) that binds a first antigen, wherein said scFv region comprises a first variable heavy chain, a variable light chain and a charged scFv linker, wherein said charged scFv linker covalently attaches said first variable heavy chain and said variable light chain; and b) a second heavy chain comprising a VH-CH1-hinge-CH2-CH3 monomer, wherein VH is a second variable heavy chain and CH2-CH3 is a second variant Fc domain; and c) a light chain; wherein said second variant Fc domain comprises amino acid substitutions N208D/Q295E/N384D/Q418E/N241D, wherein said first and second variant Fc domains each comprise amino acid substitutions E233P/L234V/L235A/G236del/S267K; and wherein said first variant Fc domain comprises amino acid substitutions S364K/E357Q and second variant Fc domain comprises amino acid substitutions L368D/K370S, wherein one of said first and second antigen binding domains binds human ICOS and the other binds human PD-1, and wherein numbering is according to the EU index as in Kabat.

In some aspects the heterodimeric antibodies have first and second variant Fc domains that each comprise M428L/N434S.

In an additional aspect, the invention provides heterodimeric antibodies comprising: a) a first heavy chain comprising: i) a first variant Fc domain; and ii) a single chain Fv region (scFv) that binds a first antigen, wherein said scFv region comprises a first variable heavy chain, a variable light chain and a charged scFv linker, wherein said charged scFv linker covalently attaches said first variable heavy chain and said variable light chain; and b) a second heavy chain comprising a VH-CH1-hinge-CH2-CH3 monomer, wherein VH is a second variable heavy chain and CH2-CH3 is a second variant Fc domain; and c) a light chain; wherein said first and second variant Fc domains comprises a set of heterodimerization variants selected from the group consisting of L368D/K370S: S364K/E357Q; L368D/K370S: S364K; L368E/K370S: S364K; T411E/K360E/Q362E: D401K; and T366S/L368A/Y407V: T366W, and wherein one of said first and second antigen binding domains binds human ICOS and the other binds human PD-1, and wherein numbering is according to the EU index as in Kabat.

In a further aspect, the invention provides nucleic acid compositions comprising nucleic acids that encode the heterodimeric antibodies of the invention, expression vector compositions comprising the nucleic acids, and host cells comprising the expression vector compositions.

In an additional aspect, the invention provides heterodimeric antibodies for use in the activation of T cells for the treatment of cancer.

BRIEF DESCRIPTION OF THE DRAWINGS

FIG. 2A to 2N depict several formats for the bispecific antibodies of the present invention. The first is the "bottle opener" format, with a first and a second anti-antigen binding domain. Additionally, mAb-Fv, mAb-scFv, Central-scFv, Central-Fv, one armed central-scFv, one scFv-mAb, scFv-mAb dual scFv format are all shown. FIG. 2J depicts the "central-scFv2" format, with two Fab-scFv arms, wherein the Fabs bind a first antigen and the scFvs bind a second antigen. FIG. 2K depicts the bispecific mAb format, with a first Fab arm binding a first antigen and a second Fab arm binding a second antigen. FIG. 2L depicts the DVD-IgG format (see, e.g., U.S. Pat. No. 7,612,181, hereby expressly incorporated by reference and as discussed below). FIG. 2M depicts the Trident format (see, e.g., WO 2015/184203, hereby expressly incorporated by reference and as discussed below). For all of the scFv domains depicted, they can be either N- to C-terminus variable heavy-(optional linker)-variable light, or the opposite. In addition, for the one armed scFv-mAb, the scFv can be attached either to the N-terminus of a heavy chain monomer or to the N-terminus of the light chain.

FIGS. 3A and 3B depicts the sequences of XENP23104, a bottle opener format with the ICOS as the Fab side ([ICOS]_H0.66_L0) and the PD-1 as the scFv (1G6_L1.94_H1.279), and includes the M428L/4345 variant to extend serum half life. The CDRs are underlined, the scFv linker is double underlined (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains. In addition, the naming convention illustrates the orientation of the scFv from N- to C-terminus; some of the sequences herein are oriented as VH-scFv linker-VL (from N- to C-terminus), while some are oriented as VL-scFv linker-VH (from N- to C-terminus), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 4A to 4F depict useful pairs of heterodimerization variant sets (including skew and pI variants). On FIGS. 4C and F, there are variants for which there are no corresponding "monomer 2" variants; these are pI variants which can be used alone on either monomer, or included on the Fab side of a bottle opener, for example, and an appropriate charged scFv linker can be used on the second monomer that utilizes a scFv as the second antigen binding domain. Suitable charged linkers are shown in FIG. 8.

FIG. 5 depict a list of isosteric variant antibody constant regions and their respective substitutions. pI_(−) indicates lower pI variants, while pI_(+) indicates higher pI variants. These can be optionally and independently combined with other heterodimerization variants of the invention (and other variant types as well, as outlined herein).

FIG. 6 depict useful ablation variants that ablate FcγR binding (sometimes referred to as "knock outs" or "KO" variants). Generally, ablation variants are found on both monomers, although in some cases they may be on only one monomer.

FIGS. 7A and 7B show two particularly useful embodiments of the invention. The "non-Fv" components of this embodiment is shown in FIG. 9A, although the other formats of FIG. 9 can be used as well.

FIGS. 8A and 8B depict a number of charged scFv linkers that find use in increasing or decreasing the pI of heterodimeric antibodies that utilize one or more scFv as a component. The (+H) positive linker finds particular use herein. A single prior art scFv linker with single charge is references as "Whitlow", from Whitlow et al., Protein Engineering 6(8):989-995 (1993). It should be noted that this linker was used for reducing aggregation and enhancing proteolytic stability in scFvs.

FIG. 9A to 9D shows the sequences of several useful bottle opener format backbones based on human IgG1, without the Fv sequences (e.g. the scFv and the vh and vl for the Fab side). Bottle opener backbone 1 is based on human IgG1 (356E/358M allotype), and includes the S364K/E357Q: L368D/K370S skew variants, the N208D/Q295E/N384D/Q418E/N421D pI variants on the Fab side and the E233P/L234V/L235A/G236del/S267K ablation variants on both chains. Bottle opener backbone 2 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 3 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 4 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 5 is based on human IgG1 (356D/358L allotype), and includes the S364K/E357Q: L368D/K370S skew variants, the N208D/Q295E/N384D/Q418E/N421D pI variants on the Fab side and the E233P/L234V/L235A/G236del/S267K ablation variants on both chains. Bottle opener backbone 6 is based on human IgG1 (356E/358M allotype), and includes the S364K/E357Q:L368D/K370S skew variants, N208D/Q295E/N384D/Q418E/N421D pI variants on the Fab side and the E233P/L234V/L235A/G236del/S267K ablation variants on both chains, as well as an N297A variant on both chains. Bottle opener backbone 7 is identical to 6 except the mutation is N297S. Alternative formats for bottle opener backbones 6 and 7 can exclude the ablation variants E233P/L234V/L235A/G236del/S267K in both chains. Backbone 8 is based on human IgG4, and includes the S364K/E357Q: L368D/K370S skew variants, the N208D/Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art. Alternative formats for bottle opener backbone 8 can exclude the ablation variants E233P/L234V/L235A/G236del/S267K in both chains Backbone 9 is based on human IgG2, and includes the S364K/E357Q:L368D/K370S skew variants, the N208D/Q295E/N384D/Q418E/N421D pI variants on the Fab side. Backbone 10 is based on human IgG2, and includes the S364K/E357Q: L368D/K370S skew variants, the N208D/Q295E/N384D/Q418E/N421D pI variants on the Fab side as well as a S267K variant on both chains.

Figure 1:
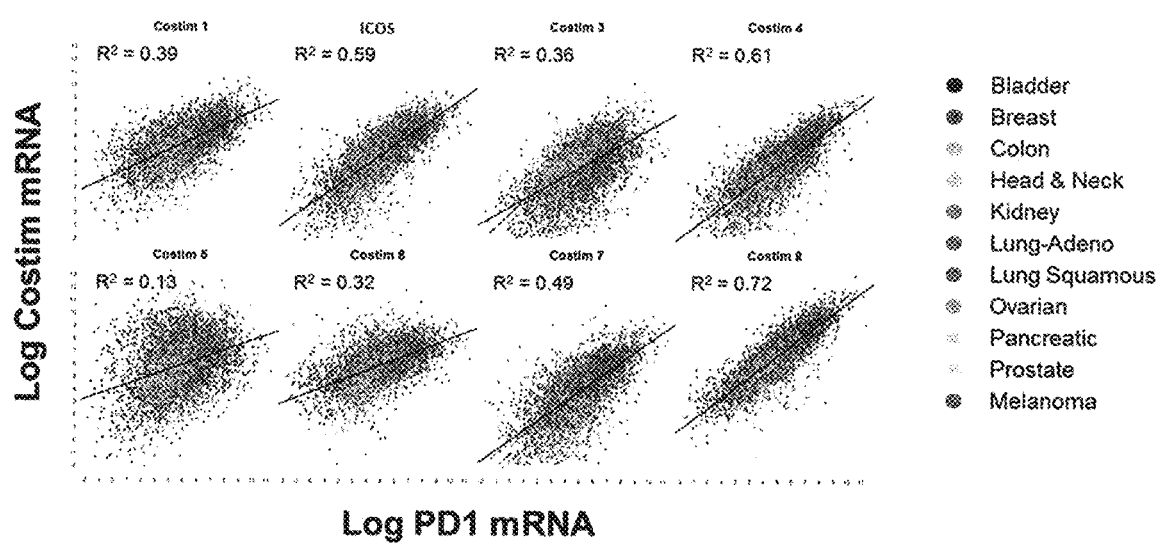
FIG. 1 presents expression data (RNAseq V2 RSEM) of PD-1 and T cell costimulatory receptors for bladder, breast, colon, head & neck, kidney, lung-adeno, lung squamous, ovarian, pancreatic, prostate, and melanoma cancer compiled from The Cancer Genome Atlas (TCGA). The square of the Pearson correlation coefficient was calculated for PD-1 against T cell costimulatory receptors.

As will be appreciated by those in the art and outlined below, these sequences can be used with any vh and vl pairs outlined herein, with one monomer including a scFv (optionally including a charged scFv linker) and the other monomer including the Fab sequences (e.g. a vh attached to the "Fab side heavy chain" and a vl attached to the "constant light chain"). That is, any Fv sequences outlined herein for anti-CTLA-4, anti-PD-1, anti-LAG-3, anti-TIM-3, anti-TIGIT and anti-BTLA, whether as scFv (again, optionally with charged scFv linkers) or as Fabs, can be incorporated into these FIG. 37 backbones in any combination. The constant light chain depicted in FIG. 9A can be used for all of the constructs in the figure, although the kappa constant light chain can also be substituted.

It should be noted that these bottle opener backbones find use in the Central-scFv format of FIG. 1F, where an additional, second Fab (vh-CH1 and vl-constant light) with the same antigen binding as the first Fab is added to the N-terminus of the scFv on the "bottle opener side".

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 10A to 10E depicts the sequences for a select number of anti-PD-1 antibodies. It is important to note that these sequences were generated based on human IgG1, with an ablation variant (E233P/L234V/L235A/G236del/S267K, "IgG1_PVA_/S267K") which is depicted in FIG. 6A. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 11A to 11E depict a select number of PD-1 ABDs, with additional anti-PD-1 ABDs being listed as SEQ 1-2392, 3125-3144, 4697-7594 and 4697-21810. The CDRs are underlined, the scFv linker is double underlines (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains. In addition, the naming convention illustrates the orientation of the scFv from N- to C-terminus; some of the sequences in this Figure are oriented as VH-scFv linker-VL (from N- to C-terminus), while some are oriented as VL-scFv linker-VH (from N- to C-terminus), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 12A to 12PP depict a select number of CTLA-4 ABDs, with additional anti-CTLA-4 ABDs being listed as SEQ ID NO:2393-2414 and 3737-3816. The CDRs are underlined, the scFv linker is double underlines (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains. In addition, the naming convention illustrates the orientation of the scFv from N- to C-terminus; some of the sequences in this Figure are oriented as VH-scFv linker-VL (from N- to C-terminus), while some are oriented as VL-scFv linker-VH (from N- to C-terminus), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 13A to 13N depict a select number of LAG-3 ABDs, with additional anti-LAG-3 ABDs being listed as SEQ ID NO:2415-2604 and 3817-3960. The CDRs are underlined, the scFv linker is double underlines (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains> In addition, the naming convention illustrates the orientation of the scFv from N- to C-terminus; some of the sequences in this Figure are oriented as VH-scFv linker-VL (from N- to C-terminus), while some are oriented as VL-scFv linker-VH (from N- to C-terminus), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 14A to 14I depicts the sequences for a select number of anti-TIM-3 antibodies. It is important to note that these sequences were generated based on human IgG1 backbone, with an ablation variant (E233P/L234V/L235A/G236del/S267K, "IgG1_PVA_/S267K") although other formats can be used as well. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 15A to 15C depicts the sequences for a select number of anti-PD-L1 antibodies. It is important to note that these sequences were generated based on human IgG1 backbone, with an ablation variant (E233P/L234V/L235A/G236del/S267K, "IgG1_PVA_/S267K") as outlined herein, although other formats can be used as well. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 16 depicts the sequences for a prototype anti-4-1BB antibody. It is important to note that these sequences were generated based on human IgG1 backbone, with an ablation variant (E233P/L234V/L235A/G236del/S267K, "IgG1_PVA_/S267K"), although the other formats can be used as well. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 17 depicts the sequences for a prototype anti-OX40 antibody. It is important to note that these sequences were generated based on human IgG1 backbone, with an ablation variant (E233P/L234V/L235A/G236del/S267K, "IgG1_PVA_/S267K"), although other formats can be used as well. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 18 depicts the sequences for a prototype anti-GITR antibody. It is important to note that these sequences were generated based on human IgG1 backbone, with an ablation variant (E233P/L234V/L235A/G236del/S267K, "IgG1_PVA_/S267K"), although other formats can be used as well. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 19A to 19G depicts the sequences for prototype anti-ICOS antibodies. It is important to note that these sequences were generated based on human IgG1 backbone, with an ablation variant (E233P/L234V/L235A/G236del/S267K, "IgG1_PVA_/S267K"), although other formats can be used as well. The CDRs are underlined. As noted herein and is true for every sequence herein containing CDRs, the exact identification of the CDR locations may be slightly different depending on the numbering used as is shown in Table X, and thus included herein are not only the CDRs that are underlined but also CDRs included within the VH and VL domains using other numbering systems.

FIG. 20A to 20G depicts sequences for exemplary anti-ICOS Fabs. The CDRs are underlined and slashes (/) indicate the border(s) of the variable regions. As noted herein and is true for every sequence herein containing CDRs, the exact identification of the CDR locations may be slightly different depending on the numbering used as is shown in Table X, and thus included herein are not only the CDRs that are underlined but also CDRs included within the VH and VL domains using other numbering systems. Furthermore, as for all the sequences in the Figures, these VH and VL sequences can be used either in a scFv format or in a Fab format. It is important to note that these sequences were generated using six-histidine (His6 or HHHHHH) (SEQ ID NO: 28666) C-terminal tags at the C-terminus of the heavy chains, which have been removed.

FIG. 21A to 21B depicts melting temperatures (Tm) and changes in melting temperature from the parental Fab (XENP22050) as determined by DSF of variant anti-ICOS Fabs engineered for stability.

FIG. 22A to 22C depicts equilibrium dissociation constants (KD), association rates (ka), and dissociation rates (kd) of variant anti-ICOS Fabs for murine Fc fusions of human ICOS captured on AMC biosensors as determined by Octet.

FIG. 23 depicts equilibrium dissociation constants (KD), association rates (ka), and dissociation rates (kd) of variant anti-ICOS Fabs for biotinylated IgG1 Fc fusions of human ICOS captured on SA biosensors as determined by Octet.

FIG. 24A to 24M depicts sequences for exemplary anti-ICOS scFvs. The CDRs are underlined, the scFv linker is double underline (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in Figure X), and slashes (/) indicate the border(s) of the variable regions. The naming convention illustrates the orientation of the scFv from N- to C-terminus; some of the sequences in this Figure are oriented as VH-scFv linker-VL (from N- to C-terminus, see FIG. 24), while some are oriented as VL-scFv linker-VH (from N- to C-terminus, see FIG. 24B), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table X, and thus included herein are not only the CDRs that are underlined but also CDRs included within the VH and VL domains using other numbering systems. Furthermore, as for all the sequences in the Figures, these VH and VL sequences can be used either in a scFv format or in a Fab format. It is important to note that these sequences were generated using polyhistidine (His6 or HHHHHH) (SEQ ID NO: 28666) C-terminal tags at the C-terminus of the heavy chains, which have been removed.

FIG. 25 depicts melting temperatures (Tm) and changes in melting temperature from the parental scFv (XENP24352; oriented as VH-scFv linker-VL from N- to C-terminus) as determined by DSF of variant anti-ICOS scFvs engineered for stability.

FIG. 26A to 26D depicts the amino acid sequences of prototype anti-costim x anti-checkpoint antibodies in the bottle-opener format (Fab-scFv-Fc). The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

Figure 27:
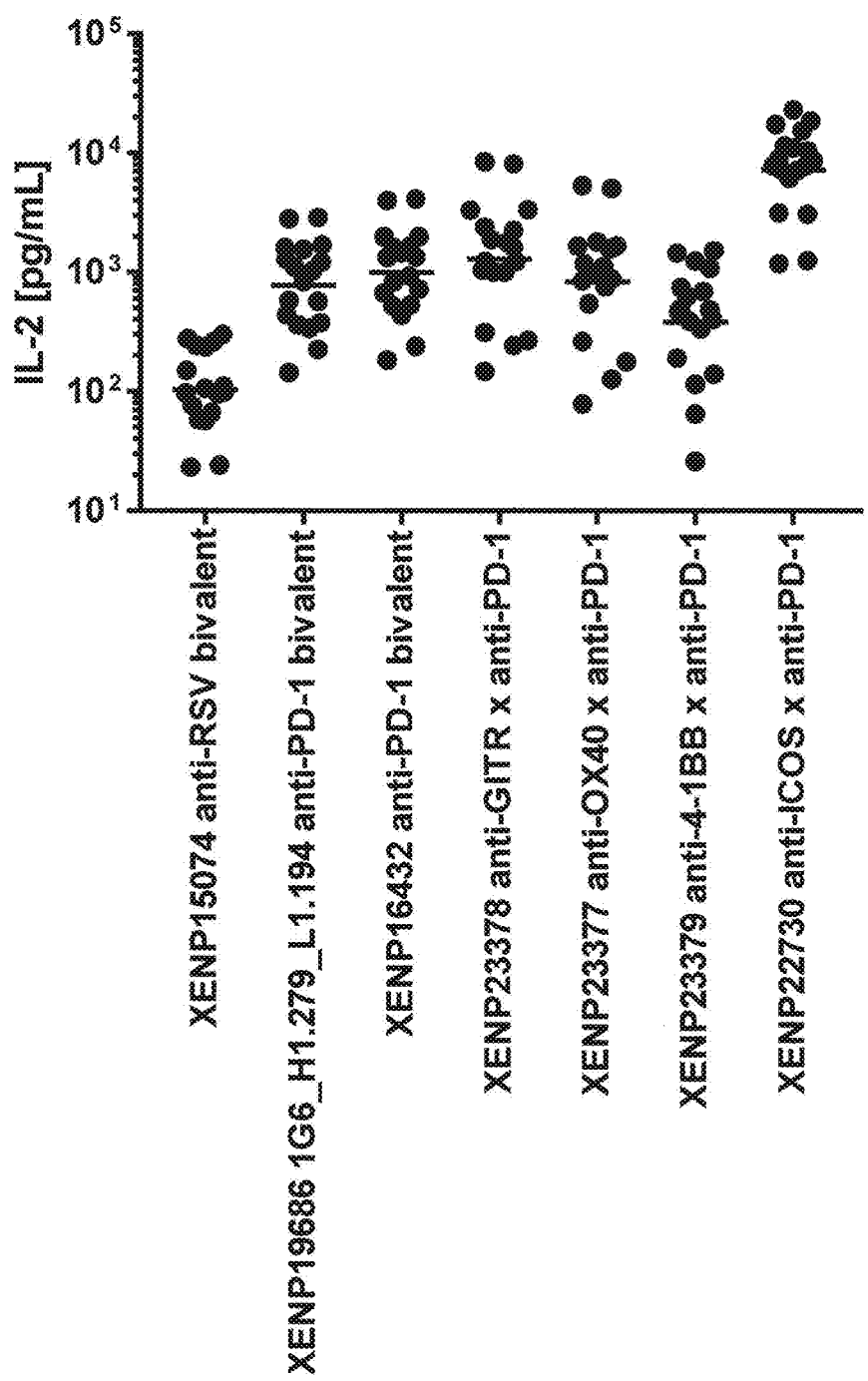

FIG. 27 depicts induction of cytokine secretion by prototype costim/checkpoint bottle-openers in an SEB-stimulated PBMC assay.

Figure 28:
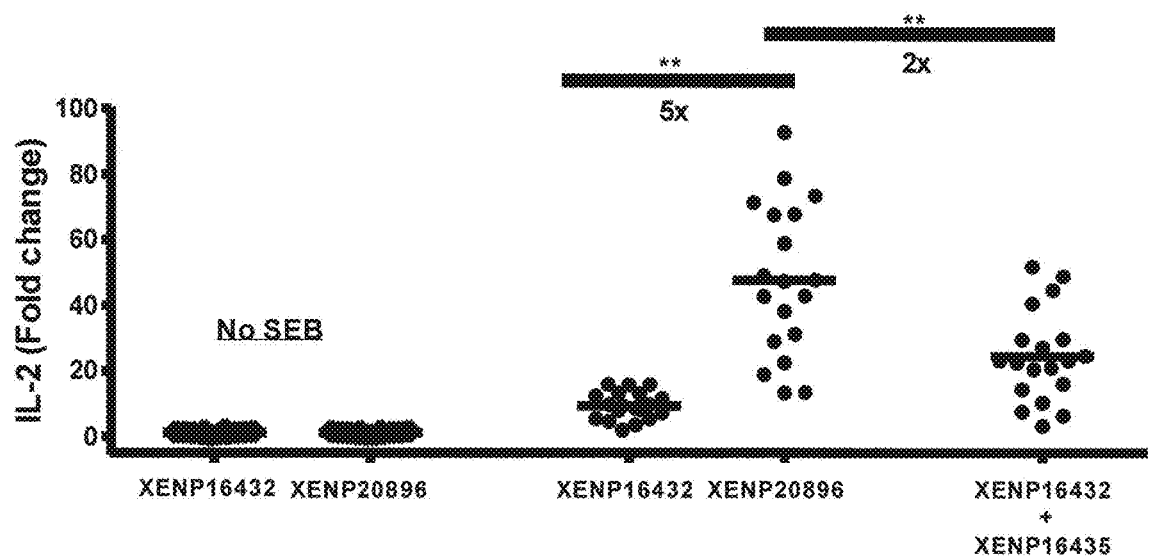

FIG. 28 depicts induction of IL-2 secretion in naive (non-SEB stimulated) and SEB-stimulated PBMCs following treatment with the indicated test articles.

Figure 29:
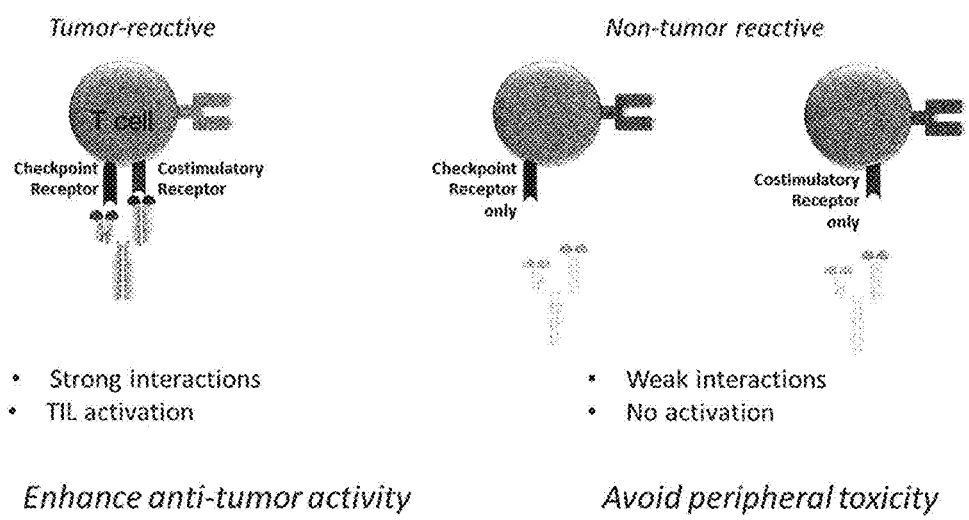

FIG. 29 depicts a schematic associated with the benefit of a costim x checkpoint blockade bispecific antibody, showing that because tumor TILs co-express immune checkpoint receptors and costimulatory receptors, a bispecific antibody increases specificity, enhancing anti-tumor activity and avoiding peripheral toxicity.

Figure 30:
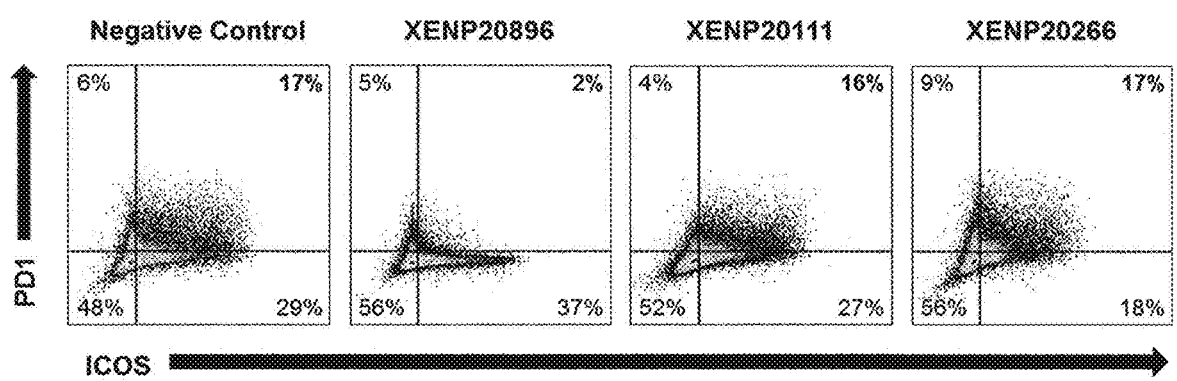

FIG. 30 depicts that double-positive cells are selectively occupied by exemplary anti-ICOS x anti-PD-1 antibody (XENP20896) as compared to one-arm anti-PD-1 antibody (XENP20111) and one-arm anti-ICOS antibody (XENP20266).

Figure 31A:
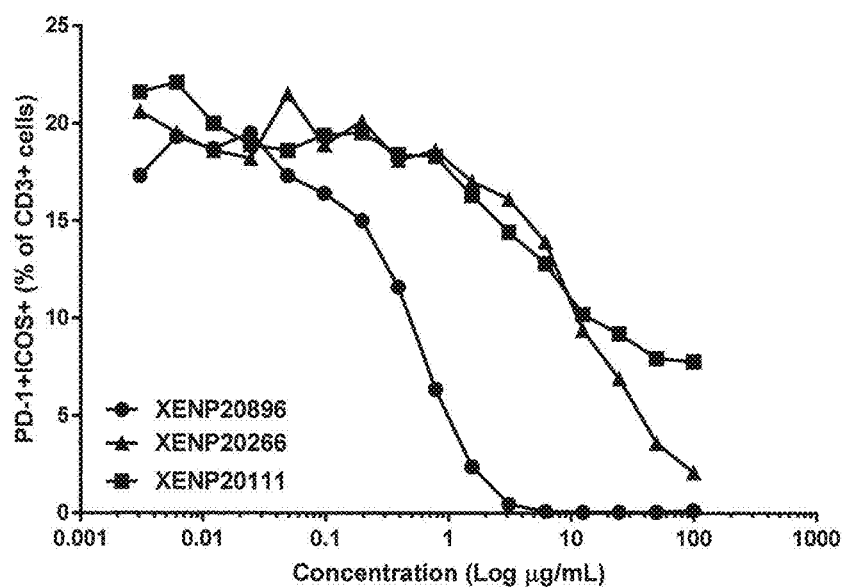
Figure 31B:
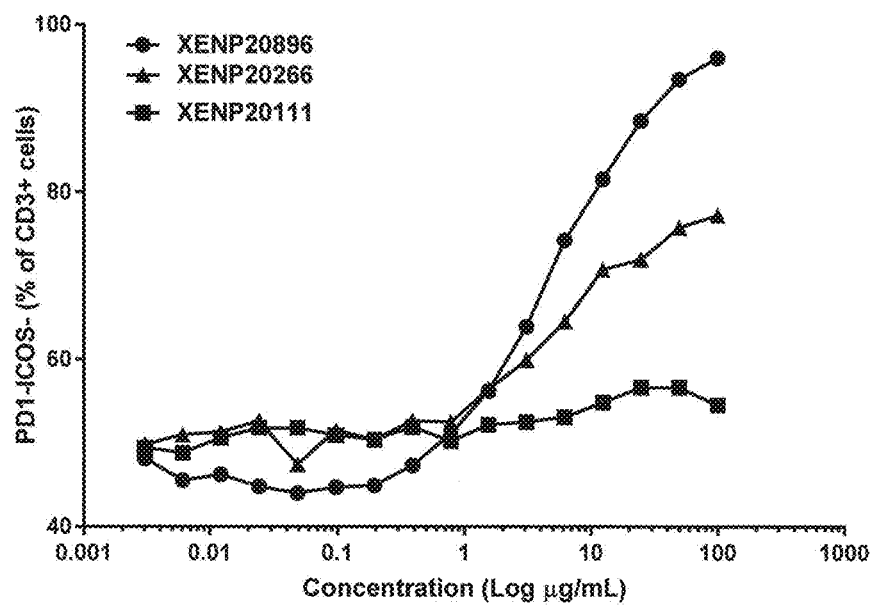

FIG. 31A to 31B shows the receptor occupancy of anti-ICOS x anti-PD-1 bispecific antibody (XENP20896), one-arm anti-ICOS antibody (XENP20266) and one-arm anti-PD-1 antibody (XENP20111) on A) PD-1 and ICOS double-positive T cells and B) PD-1 and ICOS double-negative T cells after SEB stimulation of human PBMCs.

FIG. 32A to 32D depicts the amino acid sequences of exemplary anti-ICOS x anti-PD-1 antibodies in the bottle-opener format (Fab-scFv-Fc). The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

FIG. 33A to 33C depicts the amino acid sequences of exemplary anti-ICOS x anti-PD-1 antibodies in the bottle-opener format (Fab-scFv-Fc) which include the M428L/N434S variants in one or preferably both Fc domains, which results in longer half-life in serum. The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed.

FIG. 34A to 34C depicts equilibrium dissociation constants (KD), association rates (ka), and dissociation rates (kd) of variant anti-ICOS x anti-PD-1 bispecific antibodies for murine Fc fusion of human ICOS captured on AMC biosensors as determined by Octet.

FIG. 35 depicts equilibrium dissociation constants (KD), association rates (ka), and dissociation rates (kd) of variant anti-ICOS x anti-PD-1 bispecific antibodies for biotinylated IgG1 Fc fusions of human and ICOS captured on SA/SAX biosensors as determined by Octet.

Figure 36A:
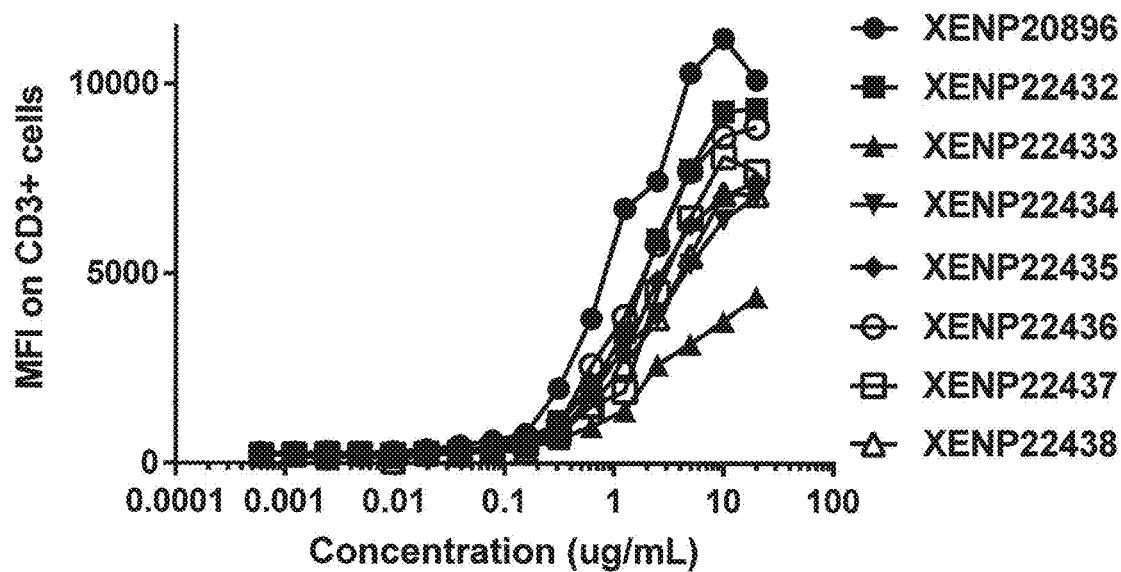
Figure 36B:
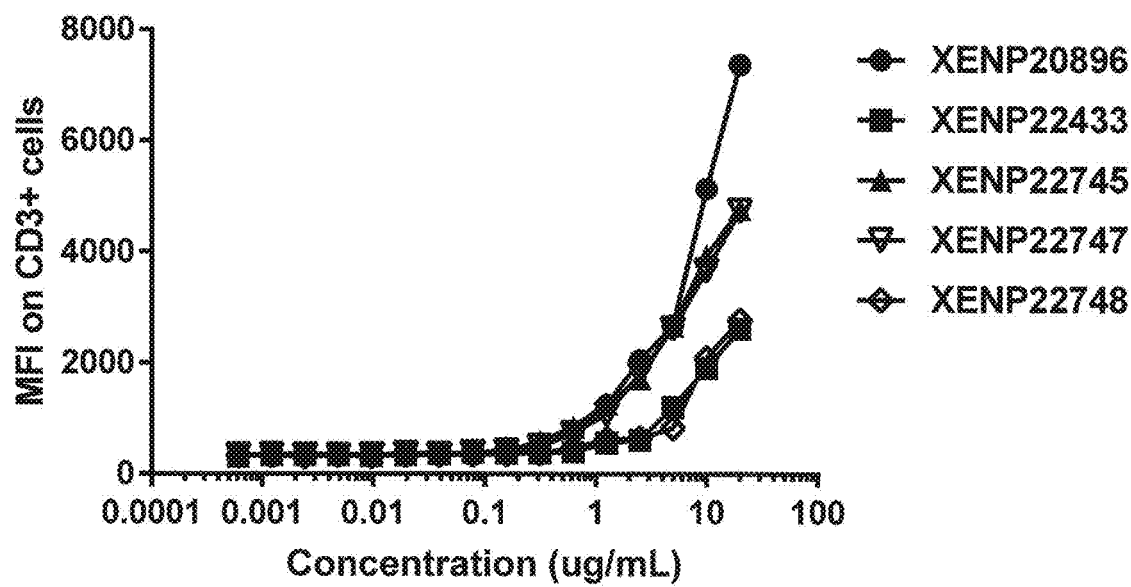

FIGS. 36A and 36B depicts cell surface binding of variant anti-ICOS x anti-PD-1 bispecific to human T cells in SEB-stimulated PBMC assays in two separate experiments depicted in A) and B).

Figure 37:
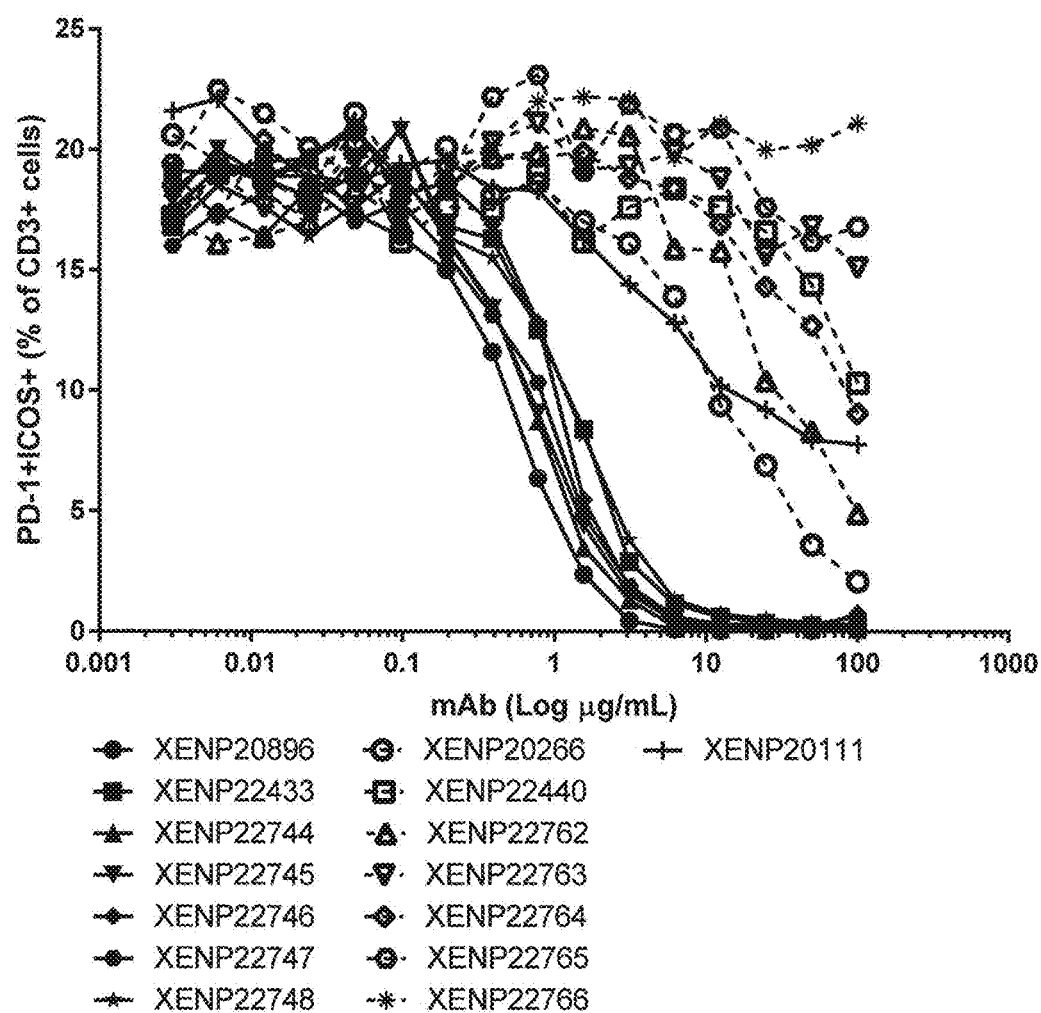

FIG. 37 shows the receptor occupancy of variant anti-ICOS x anti-PD-1 bispecific antibodies, one-arm anti-ICOS antibodies and one-arm anti-PD-1 antibody (XENP20111) on PD-1 and ICOS double-positive T cells after SEB stimulation of human PBMCs.

Figure 38A:
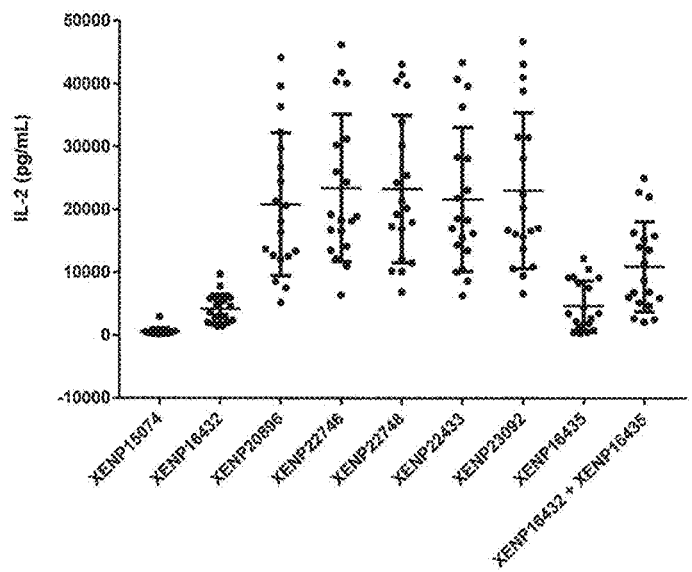
Figure 38B:
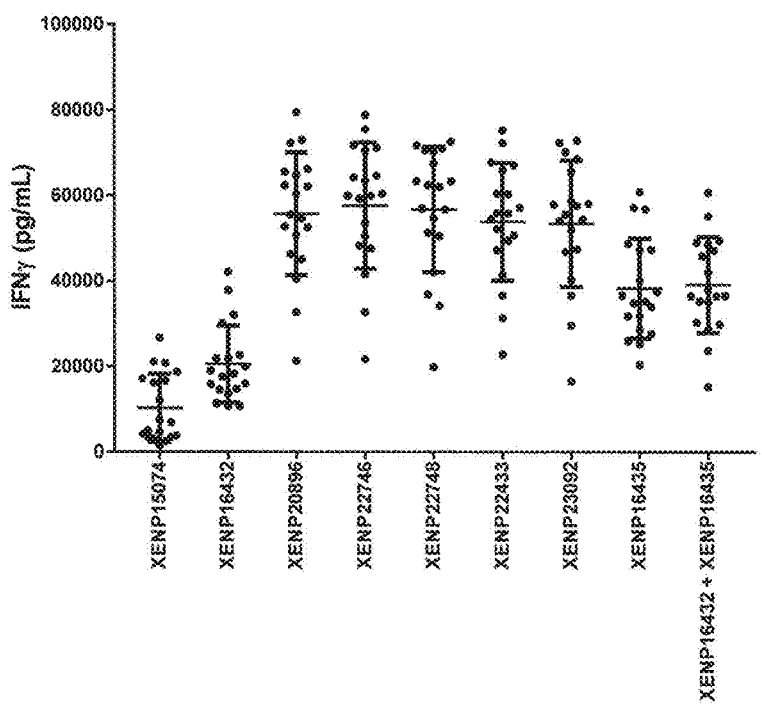

FIGS. 38A and 38B show that variant anti-ICOS x anti-PD-1 bispecific antibodies promote A) IL-2 and B) IFNγ secretion from SEB stimulated PBMCs.

Figure 39A:
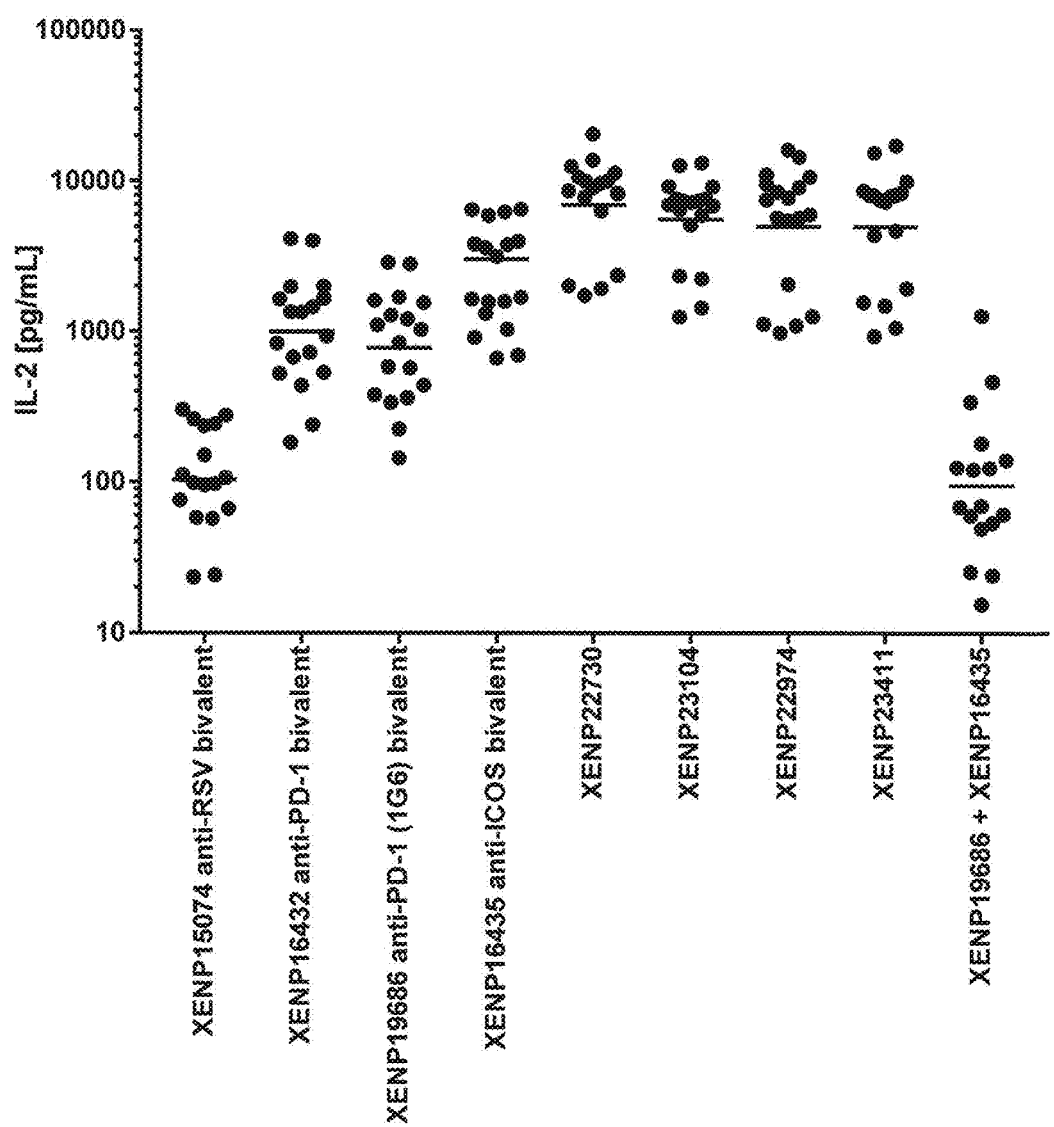
Figure 39B:
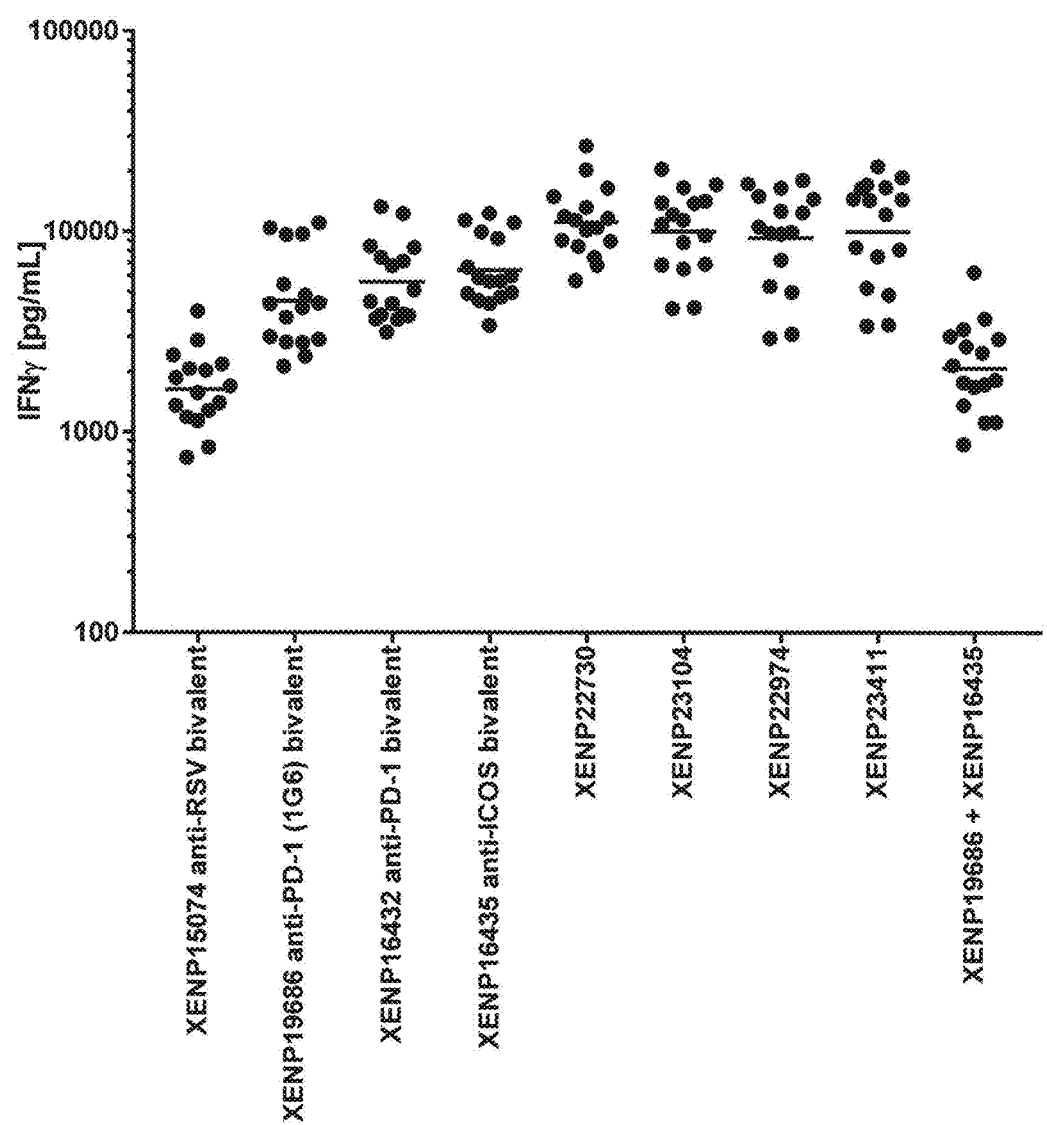

FIGS. 39A and 39B show that variant anti-ICOS x anti-PD-1 bispecific antibodies promote A) IL-2 and B) IFNγ secretion from SEB-stimulated PBMCs.

Figure 40A:
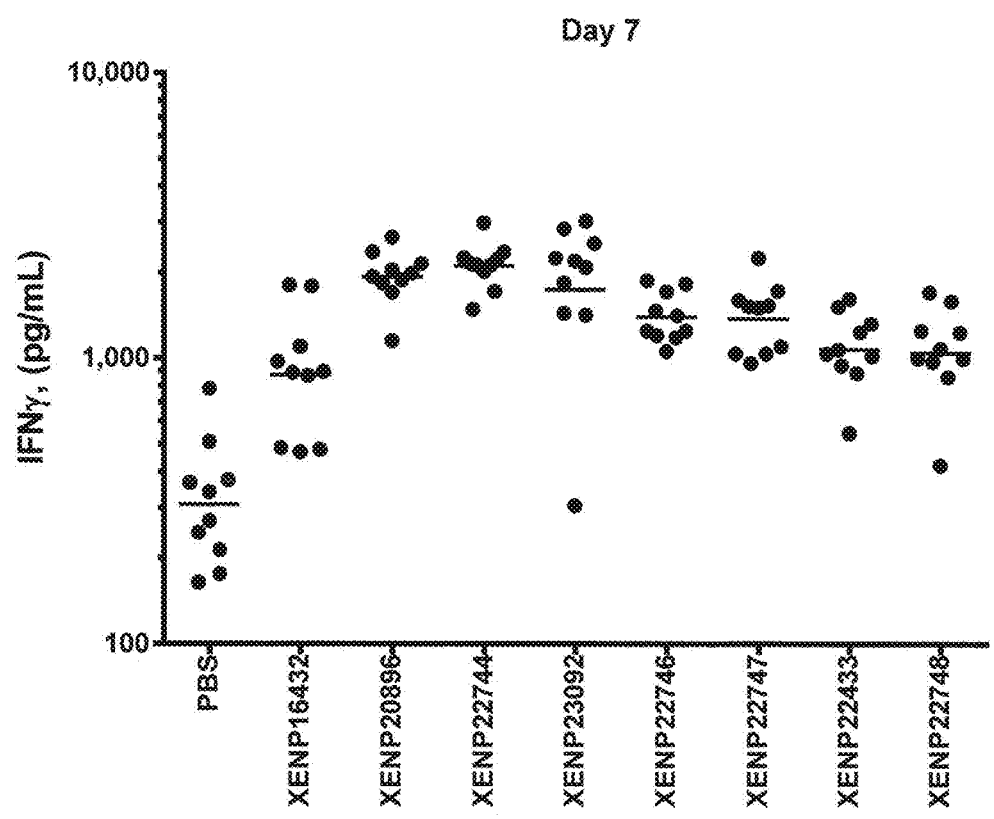
Figure 40B:
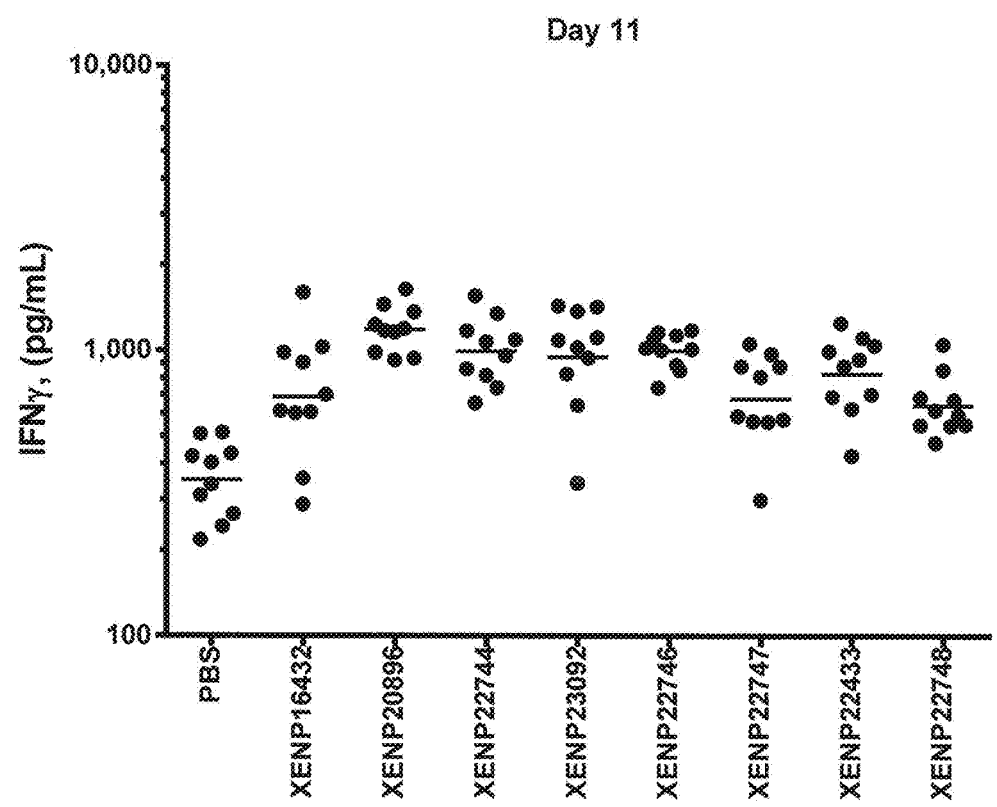

FIGS. 40A and 40B depicts the concentration of IFNγ in mice on Day A) 7 and B) 11 after engraftment with human PBMCs and treatment with the indicated test articles.

Figure 41B:
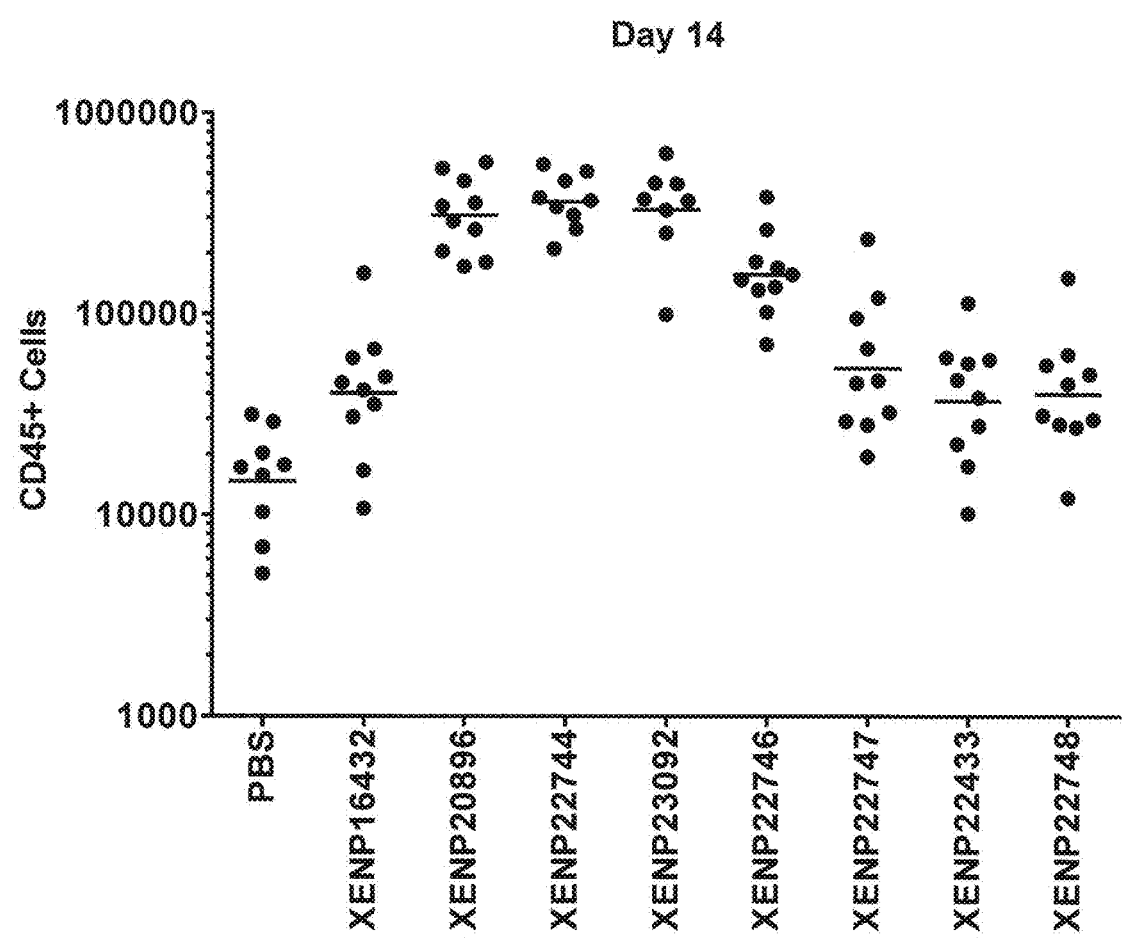

FIGS. 41A and 41B depicts CD45+ cell counts in mice as determined by flow cytometry on Day A) 11 and B) 14 after engraftment with human PBMCs and treatment with the indicated test articles.

Figure 42A:
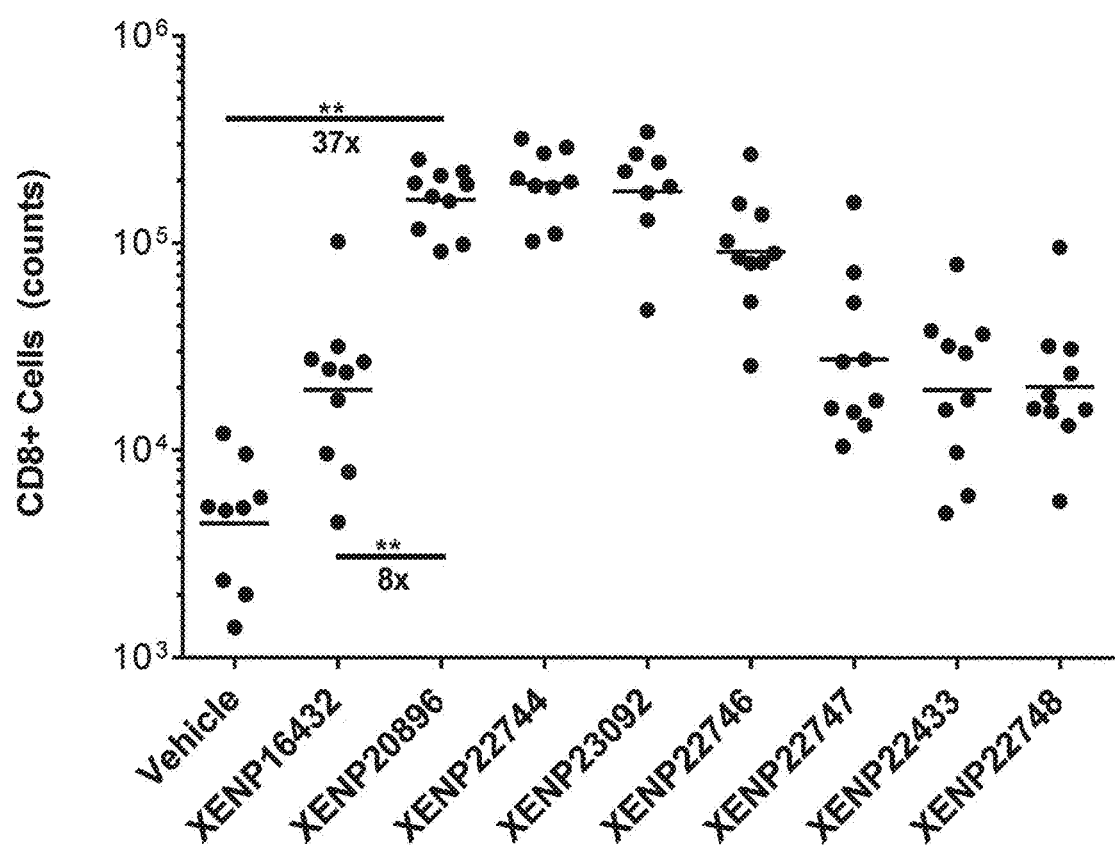
Figure 42B:
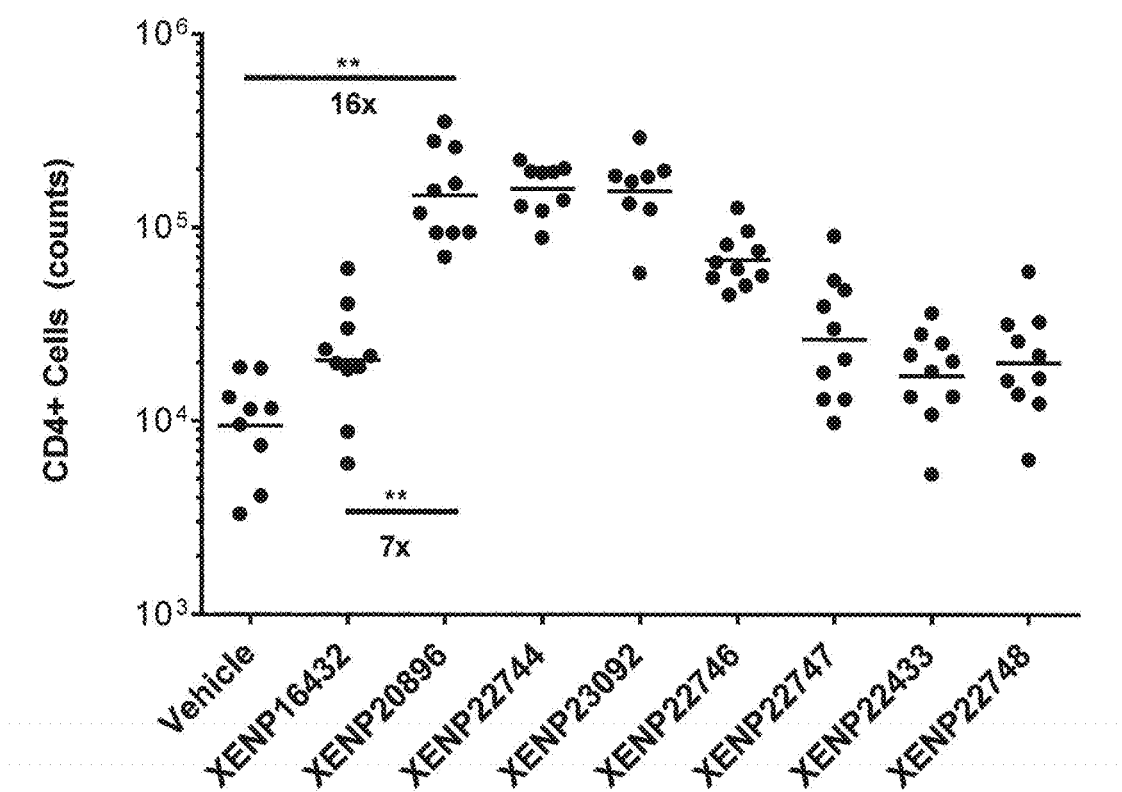

FIGS. 42A and 42B depicts A) CD8+ T cell and B) CD4+ T cell counts in mice as determined by flow cytometry on Day 14 after engraftment with human PBMCs and treatment with the indicated test articles (**p≤0.01).

Figure 43:
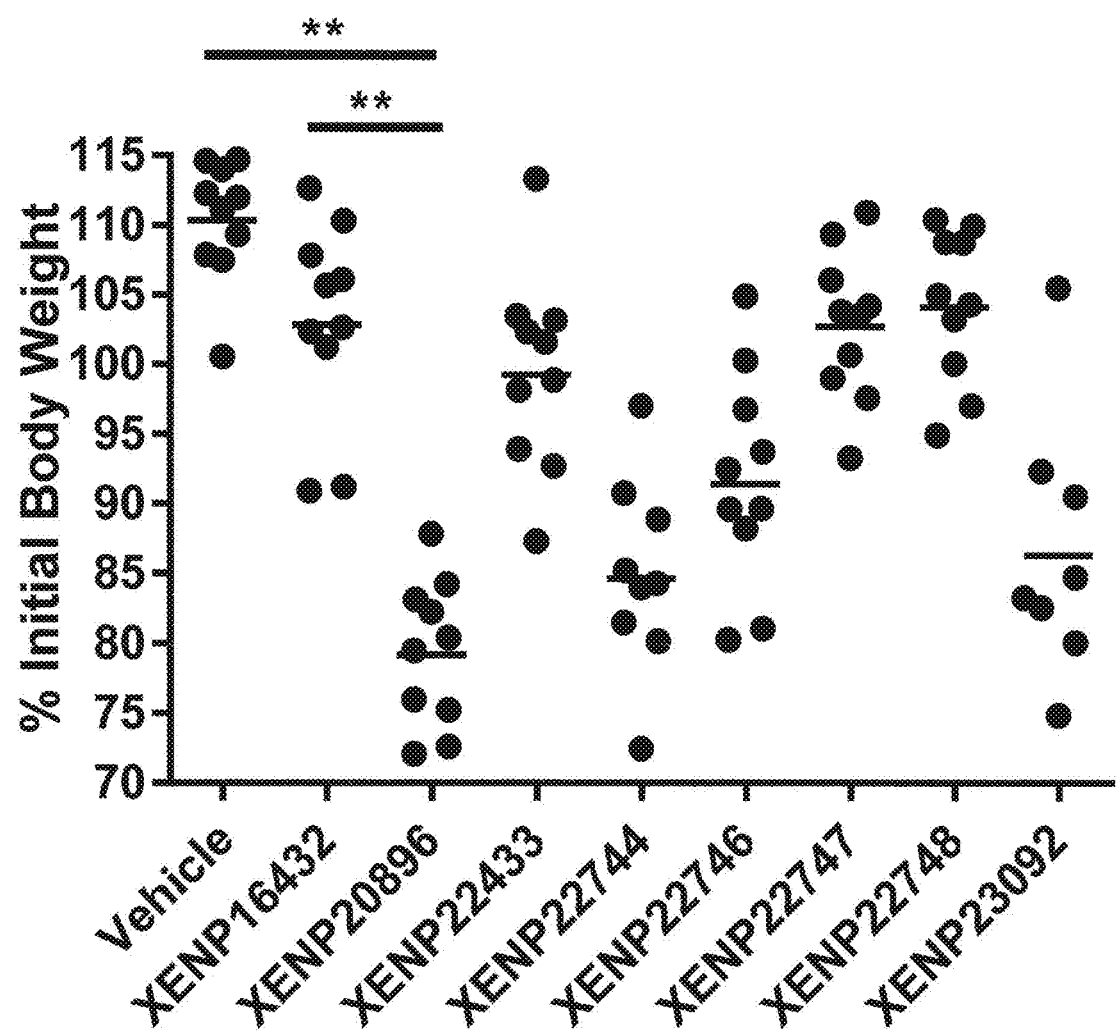

FIG. 43 depicts the change in body weight in mice by Day 14 after engraftment with human PBMCs and treatment with the indicated test articles (**p≤0.01).

Figure 44A:
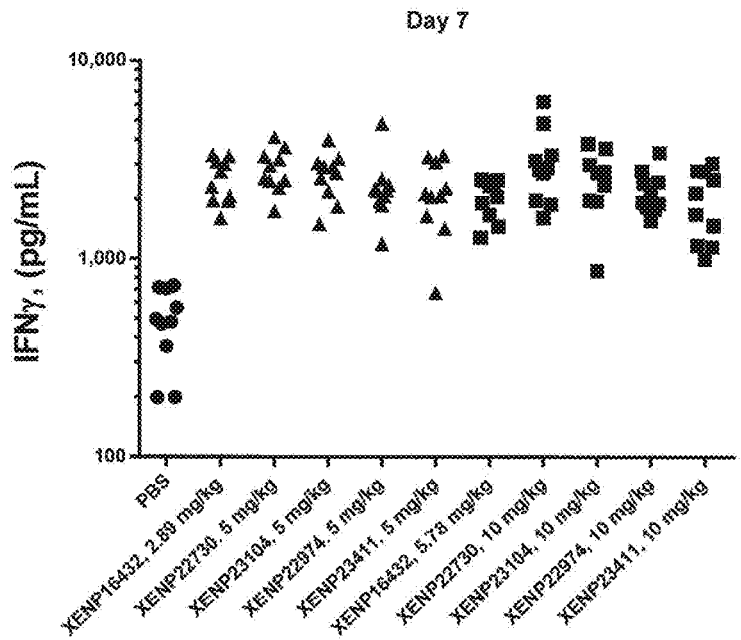
Figure 44B:
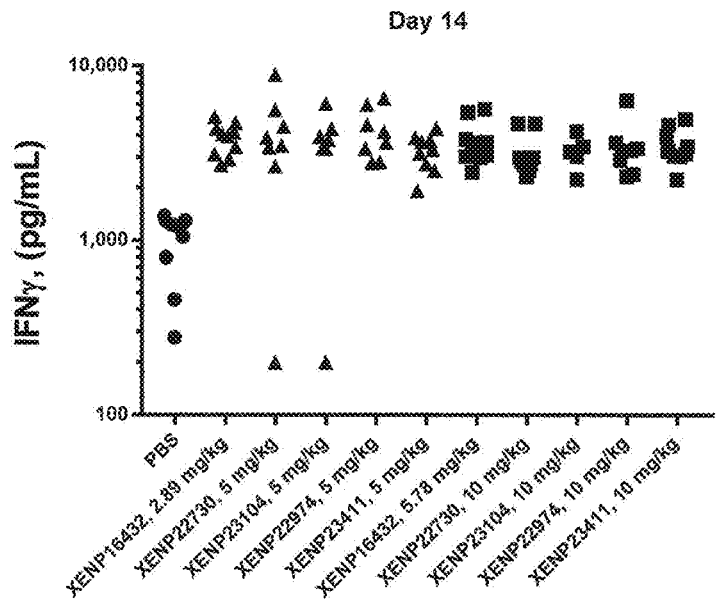

FIGS. 44A and 44B depicts the concentration of IFNγ in mice on Day A) 7 and B) 14 after engraftment with human PBMCs and treatment with the indicated test articles.

Figure 45:
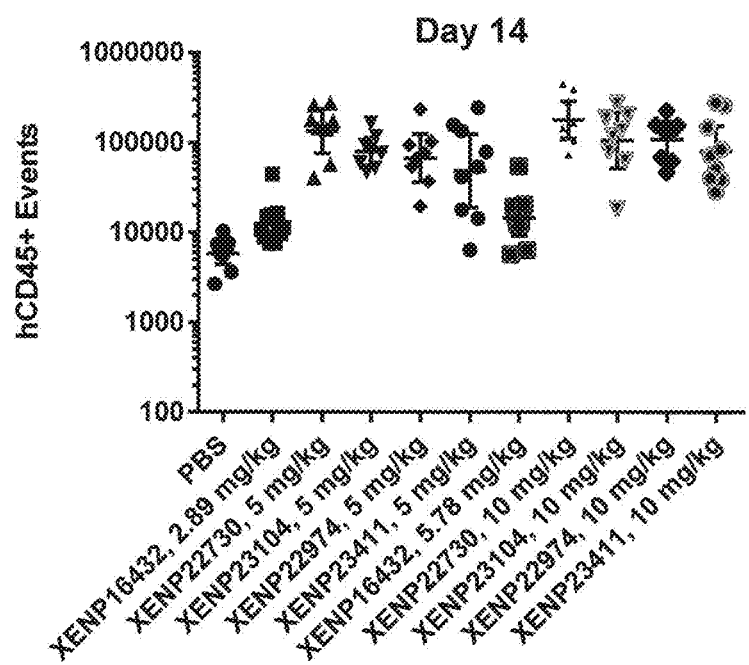

FIG. 45 depicts CD45+ cell counts in mice as determined by flow cytometry on Day 14 after engraftment with human PBMCs and treatment with the indicated test articles.

Figure 46A:
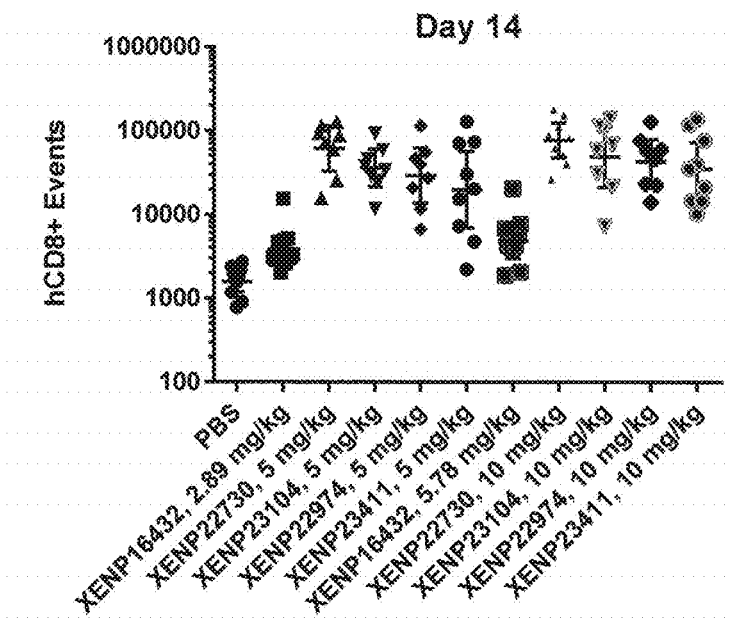
Figure 46B:
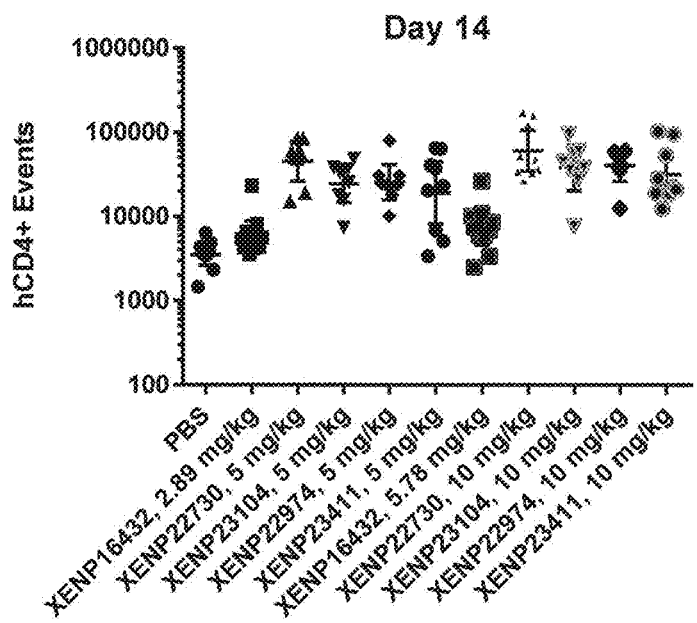
Figure 46C:
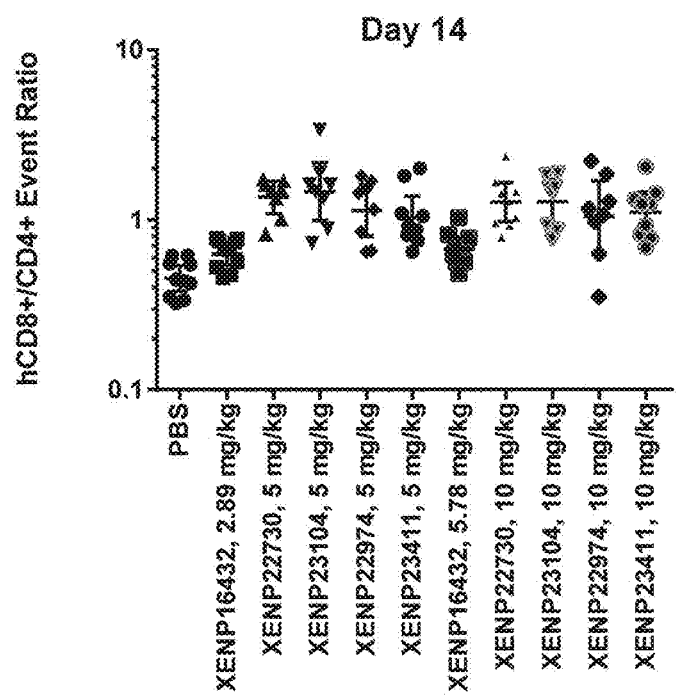

FIG. 46A to 46C depicts A) CD8+ T cell and B) CD4+ T cell counts in mice as determined by flow cytometry on Day 14 after engraftment with human PBMCs and treatment with the indicated test articles."

Figure 47A:
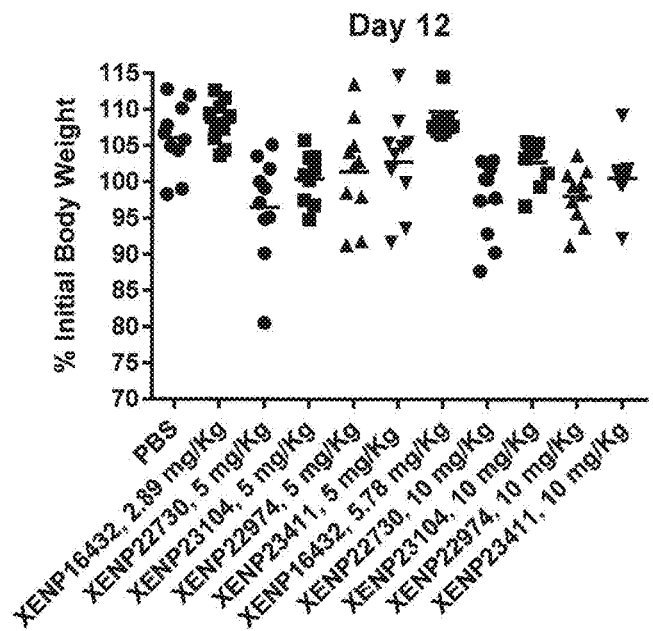
Figure 47B:
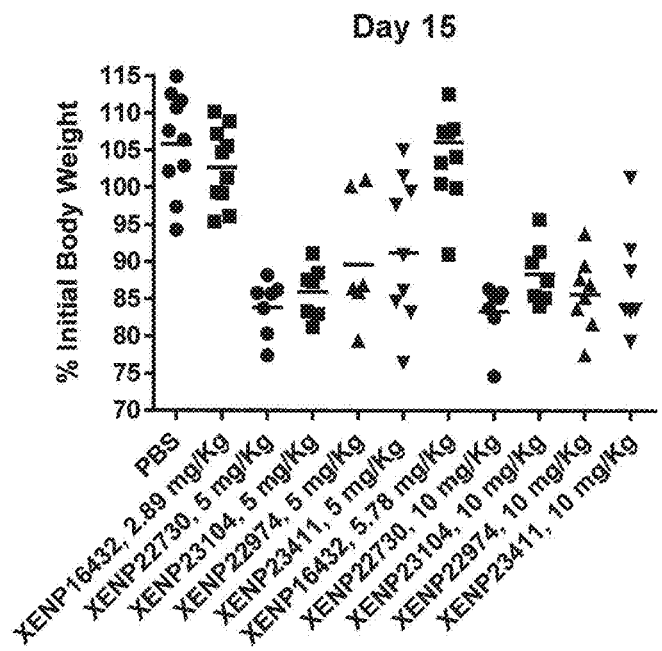

FIGS. 47A and 47B depicts the change in body weight in mice by Day 12 and 15 after engraftment with human PBMCs and treatment with the indicated test articles.

FIG. 48A to 48 depicts the amino acid sequences of exemplary anti-ICOS x anti-PD-1 antibodies in the bottle-opener format (Fab-scFv-Fc) with alternative ICOS ABDs. The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

Figure 49:
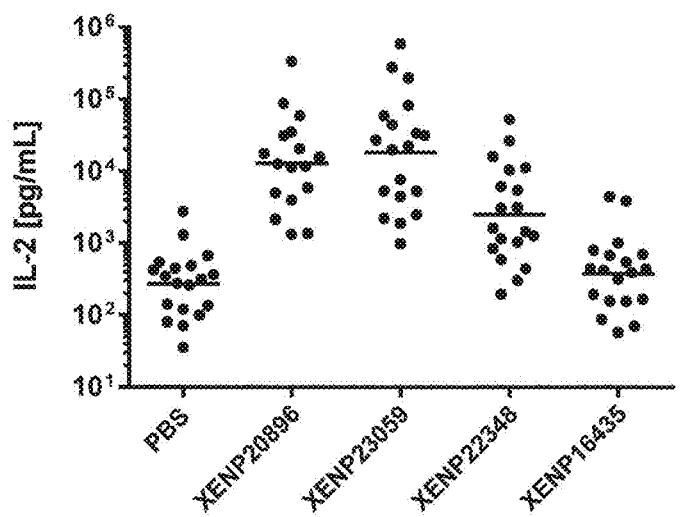

FIG. 49 depict cytokine release assay for IL-2 after SEB-stimulation of human PBMCs and treatment with alternative anti-ICOS x anti-PD-1 bispecific antibodies.

Figure 50:
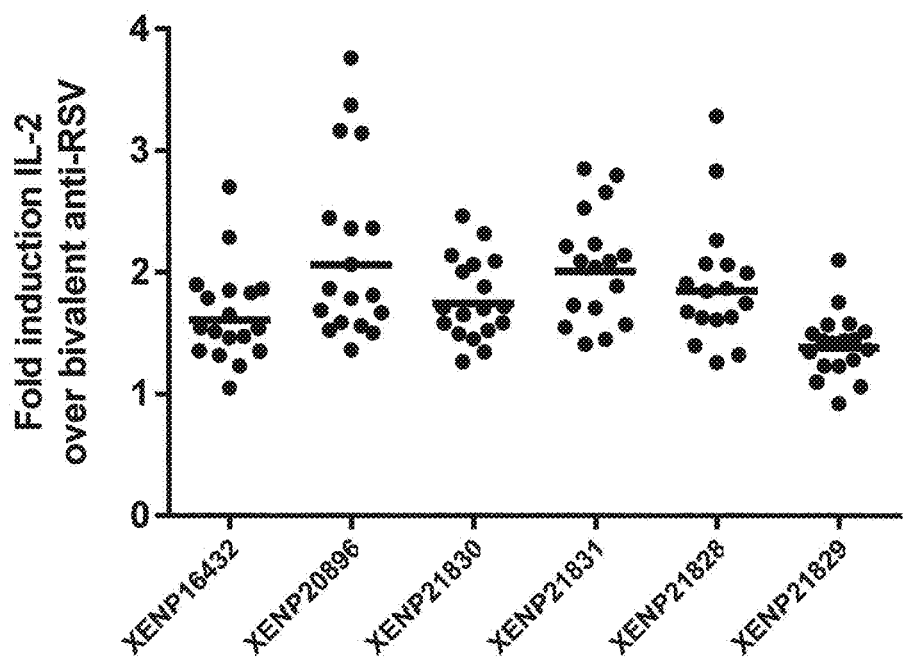

FIG. 50 depict cytokine release assay for IL-2 (as fold induction over bivalent anti-RSV mAb) after SEB-stimulation of human PBMCs and treatment with alternative anti-ICOS x anti-PD-1 bispecific antibodies.

Figure 51:
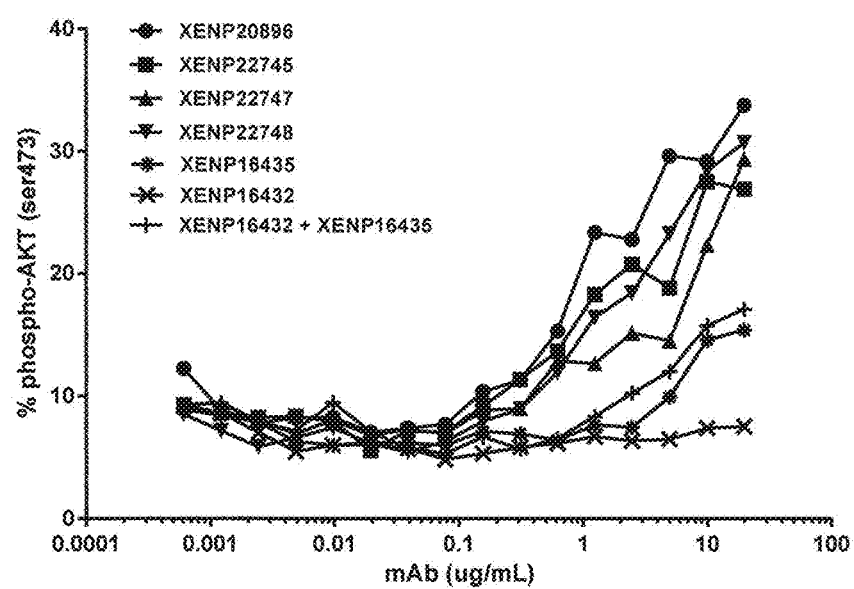
Figure 53A:
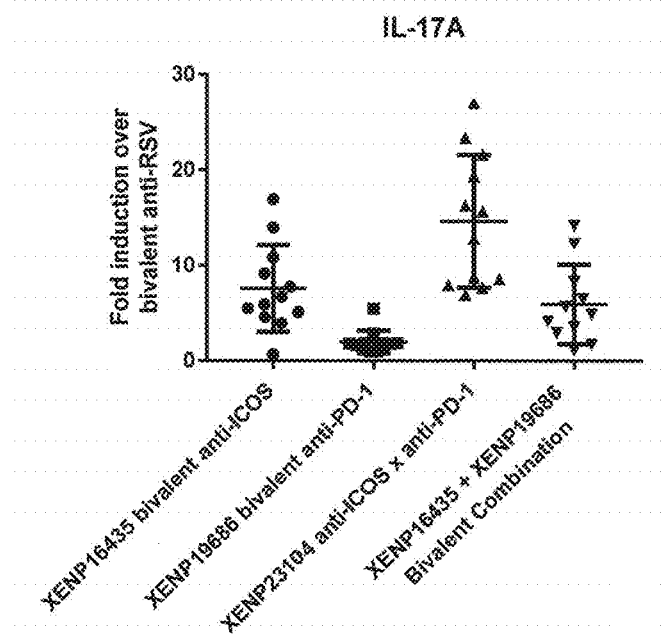
Figure 53B:
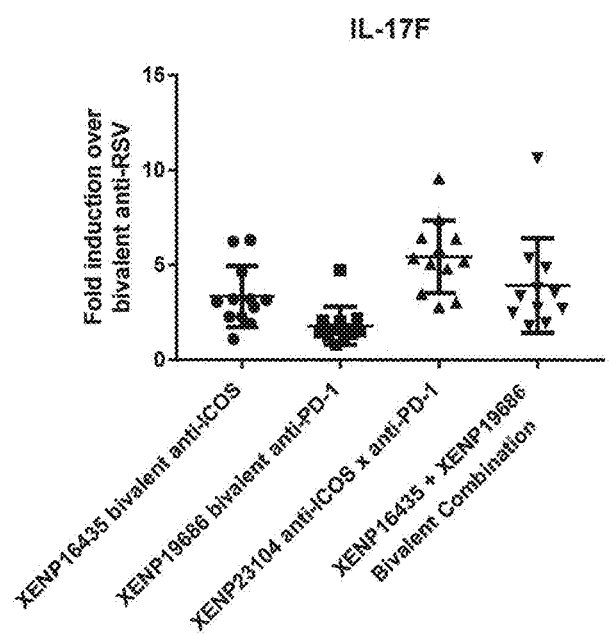
Figure 53C:
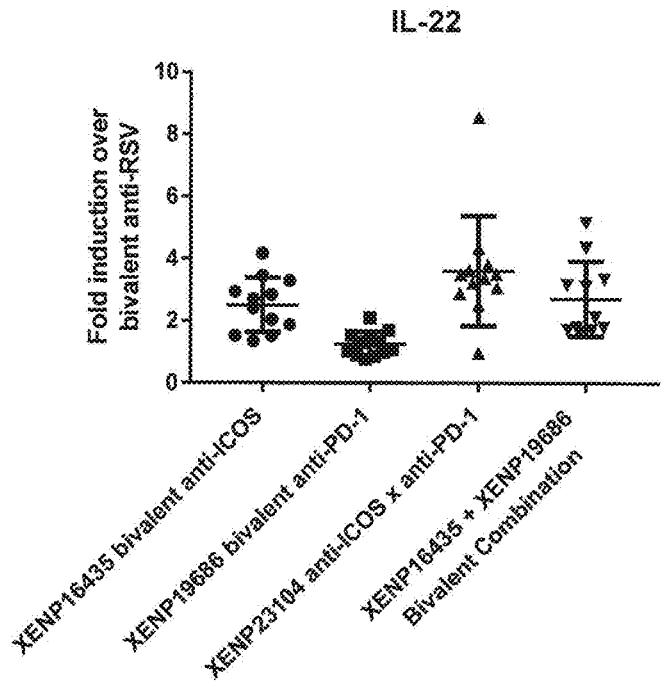
Figure 53D:
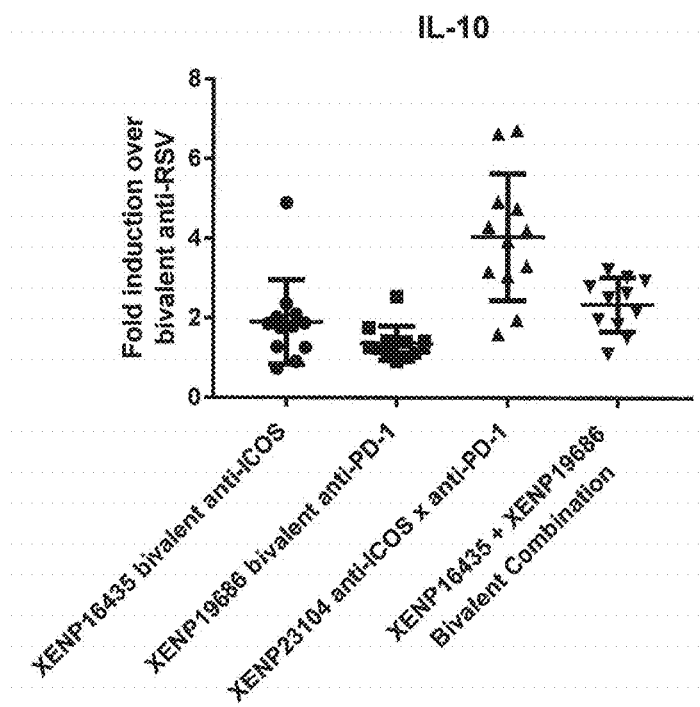
Figure 53E:
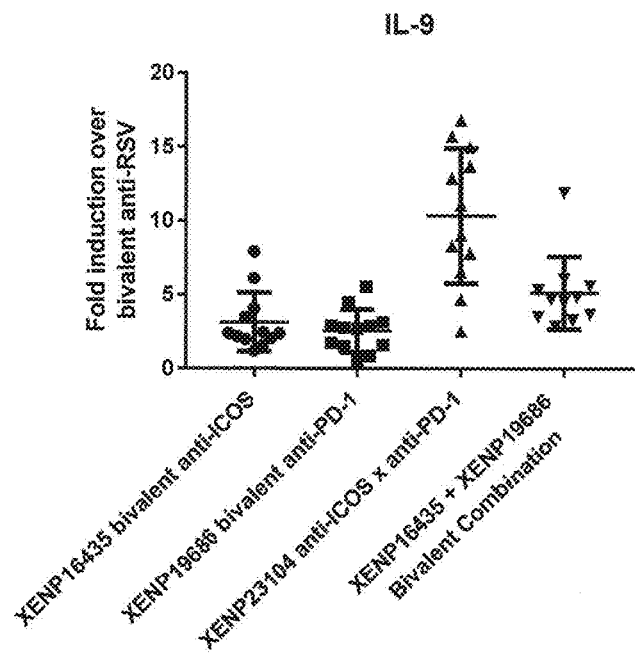
Figure 53F:
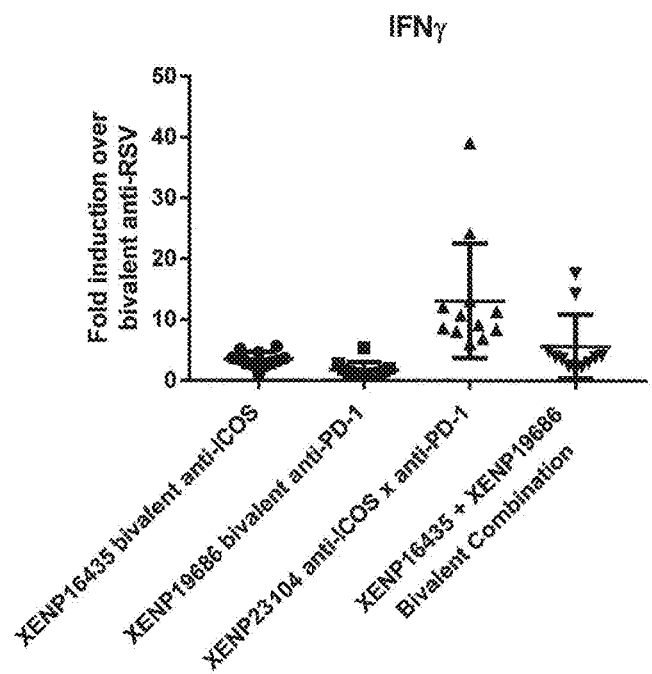

FIG. 51 depicts AKT phosphorylation in SEB-stimulated purified CD3+ T cells after treatment with anti-ICOS x anti-PD-1 bispecific antibodies.

FIG. 52 depicts fold induction of A) IL-17A, B) IL17F, C) IL-22, D) IL-10, E) IL-9, and F) IFNγ gene expression by the indicated test articles over induction by bivalent anti-RSV as determined by NanoString.

FIG. 53A to 53F depict mean fold induction in expression of selected immune response genes by indicated test articles over treatment with bivalent anti-RSV mAb as determined by NanoString. The shading intensity corresponds to the magnitude of the fold change.

Figure 54:
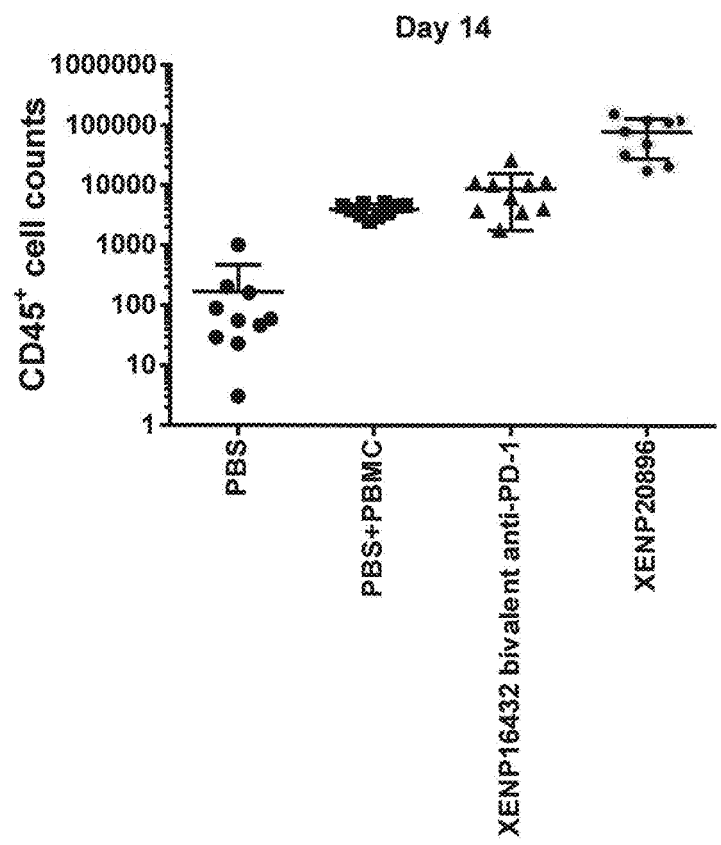

FIG. 54 depicts CD45+ cell counts in mice as determined by flow cytometry on Day 14 after engraftment with human PBMCs and treatment with the indicated test articles.

FIGS. 55A to 55D, similar to FIG. 9 and FIG. 75, depicts the sequences of the "backbone" portion (e.g. without the Fvs) of a number of additional formats, including the Central scFv of FIG. 2F, the Central-scFv2 format of FIG. 2J, the bispecific mAb of FIG. 2K, the DVD-Ig of FIG. 2L and the Trident format of FIG. 2M. In FIG. 2L, the DVD-Ig® linkers are shown with double underlining, with other linkers found in WO2007/024715, hereby incorporated by reference in its entirety and in particular for those sequences. In the Trident format, other Trident linkers and coil-coil sequences are shown in WO 2015/184203, hereby incorporated by reference in its entirety and in particular for those sequences. As will be appreciated by those in the art, bolded domains (e.g. "VH1", VH2-scFv linker-VL2", etc.) are separated with slashes "/", and may include optional domain linkers as needed. All of these backbones utilize the kappa constant region for the light chain, although the lambda chain can also be used. As for FIG. 9 and FIG. 75, these backbones can be combined with any vh and vl domains as outlined herein.

FIGS. 56A and 56B depicts the amino acid sequence of illustrative anti-PD-1 x anti-ICOS antibodies in the bottle-opener format (Fab-scFv-Fc). The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

FIG. 57A to 57C depicts the amino acid sequence of illustrative anti-PD-1 x anti-ICOS antibodies in the central-scFv format. The antibodies are named using the first Fab-Fc variable region first and the Fab-scFv-Fc variable region second, separated by a dash, followed by the chain designation (Fab-Fc heavy chain, Fab-scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

FIG. 58 depicts the amino acid sequence of illustrative anti-PD-1 x anti-ICOS antibodies in the central-scFv2 format. The antibodies are named using the Fab variable region first and the scFv variable region second, followed by the chain designation (heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

FIG. 59 depicts the amino acid sequence of an illustrative anti-PD-1 x anti-ICOS antibody in the bispecific mAb format. The antibodies are named using the first Fab variable region for a first antigen and the second Fab variable region for a second antigen, separated by a dash, followed by the chain designation (Heavy Chain 1 or Light Chain 1 for the first antigen and Heavy Chain 2 or Light Chain 2 for the second antigen). CDRs are underlined and slashes indicate the border(s) of the variable regions. Each sequence outlined herein can include or exclude the M428L/N434S variants in one or preferably both Fc domains, which results in longer half-life in serum.

FIG. 60 depicts the amino acid sequence of an illustrative anti-PD-1 x anti-ICOS antibody in the DVD-IgG format. The antibodies are named using the first variable region for a first antigen and the second Fab variable region for a second antigen, followed by the chain designation (Heavy Chain or Light Chain). CDRs are underlined and slashes indicate the border(s) of the variable regions. Each sequence outlined herein can include or exclude the M428L/N434S variants in one or preferably both Fc domains, which results in longer half-life in serum.

FIGS. 61A and 61B depicts the amino acid sequence of an illustrative anti-PD-1 x anti-ICOS antibody in the Trident format. The antibodies are named using the VL and VH of a first antigen which comprises a DART and the Fab variable region for a second antigen, separated by a dash, followed by the chain designation (Heavy Chain or Light Chain). CDRs are underlined and slashes indicate the border(s) of the variable regions. Each sequence outlined herein can include or exclude the M428L/N434S variants in one or preferably both Fc domains, which results in longer half-life in serum.

Figure 62:
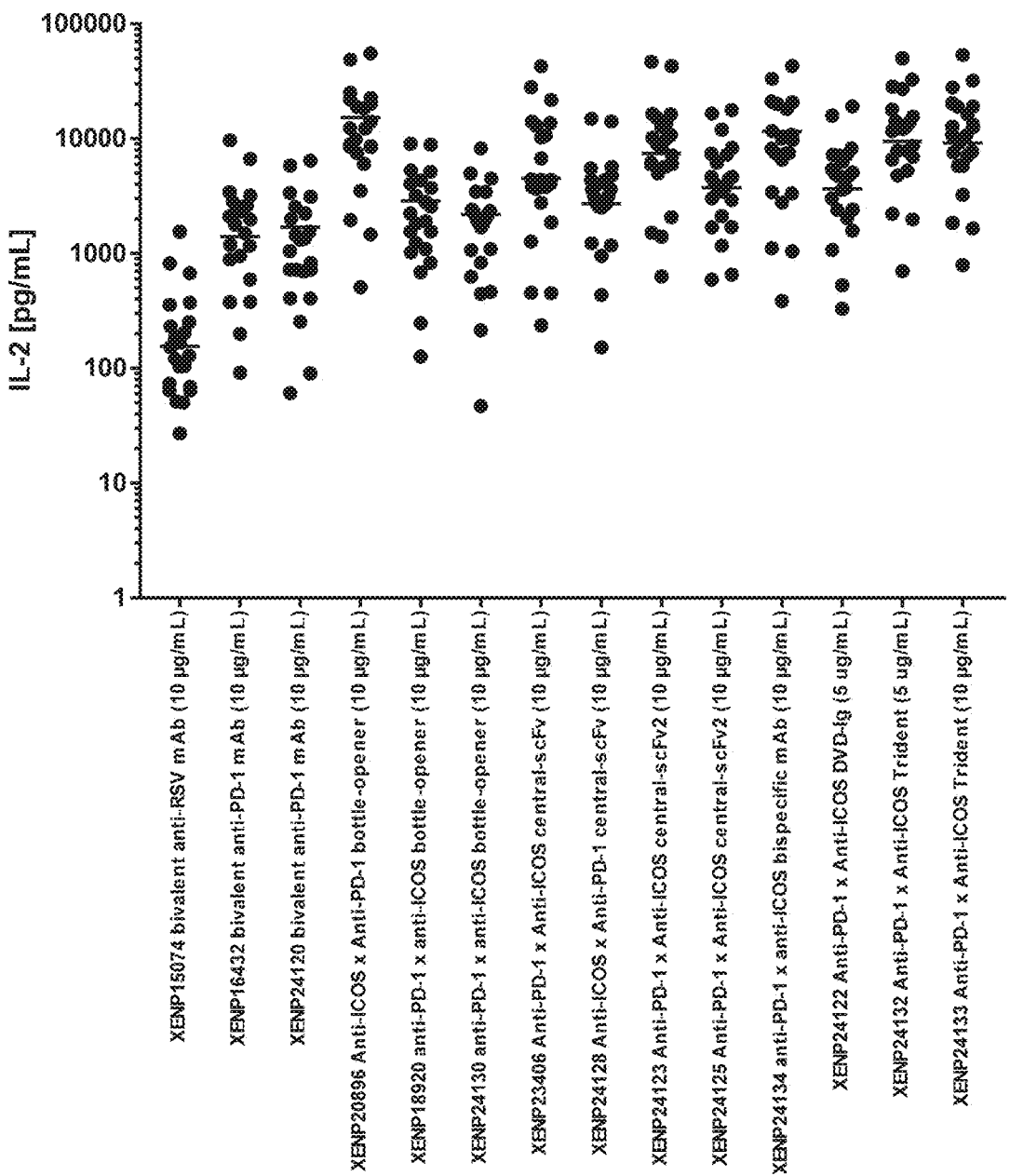

FIG. 62 depicts induction of cytokine secretion (IL-2) by alternative format costim x checkpoint blockade bispecific antibodies in an SEB-stimulated PBMC assay.

FIG. 63 depicts the amino acid sequences of an illustrative anti-ICOS x anti-CTLA-4 antibody in the bottle-opener format (Fab-scFv-Fc). The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

FIGS. 64A and 64B depicts the amino acid sequence of illustrative anti-LAG-3 x anti-ICOS antibodies in the bispecific mAb format. The antibodies are named using the first Fab variable region for a first antigen and the second Fab variable region for a second antigen, separated by a dash, followed by the chain designation (Heavy Chain 1 or Light Chain 1 for the first antigen and Heavy Chain 2 or Light Chain 2 for the second antigen). CDRs are underlined and slashes indicate the border(s) of the variable regions. Each sequence outlined herein can include or exclude the M428L/N434S variants in one or preferably both Fc domains, which results in longer half-life in serum.

FIG. 65 depicts the amino acid sequence of an illustrative anti-TIM-3 x anti-ICOS antibody in the bispecific mAb format. The antibodies are named using the first Fab variable region for a first antigen and the second Fab variable region for a second antigen, separated by a dash, followed by the chain designation (Heavy Chain 1 or Light Chain 1 for the first antigen and Heavy Chain 2 or Light Chain 2 for the second antigen). CDRs are underlined and slashes indicate the border(s) of the variable regions. Each sequence outlined herein can include or exclude the M428L/N434S variants in one or preferably both Fc domains, which results in longer half-life in serum.

FIG. 66A to 66C depicts the amino acid sequences of anti-ICOS x anti-PD-L1 antibodies in the bottle-opener format (Fab-scFv-Fc) and central-scFv2 format. The bottle-openers are named using the Fab variable region first and the scFv variable region second, separated by a dash, followed by the chain designation (Fab-Fc heavy chain, scFv-Fc heavy chain or light chain). Central-scFv2s are named using the Fab variable region first and the scFv variable region second, followed by the chain designation (heavy chain or light chain). CDRs are underlined and slashes indicate the border(s) of the variable regions. CDRs are underlined and slashes indicate the border(s) of the variable regions. The scFv domain has different orientations (N- to C-terminus) of either VH-scFv linker-VL or VL-scFv linker-VH as indicated, although this can be reversed. In addition, each sequence outlined herein can include or exclude the M428L/N434S variants in one or preferably both Fc domains, which results in longer half-life in serum.

Figure 67:
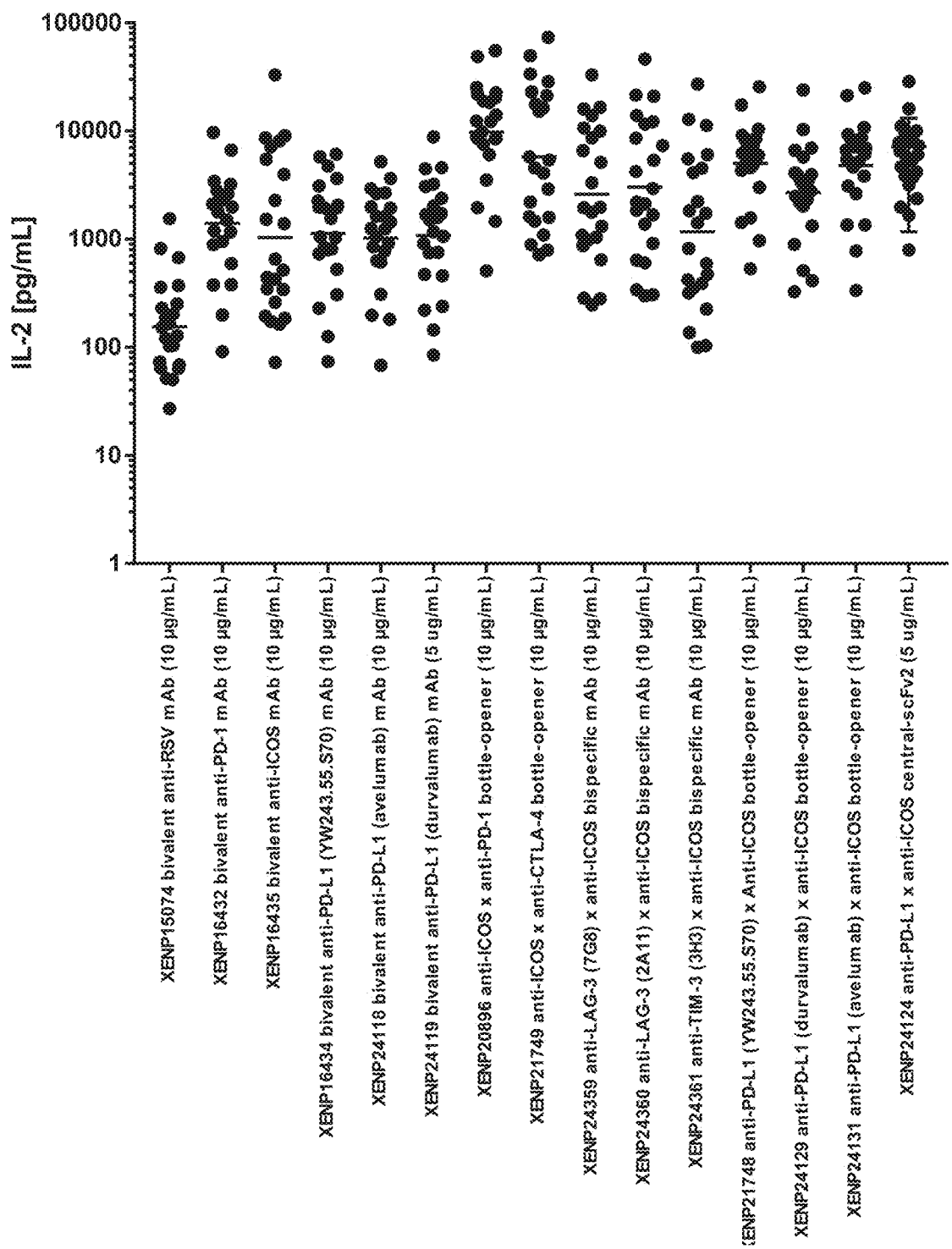

FIG. 67 depicts induction of cytokine secretion (IL-2) by additional costim x checkpoint blockade bispecific antibodies in an SEB-stimulated PBMC assay.

FIG. 68A to 68G depict amino acid sequences for exemplary one-arm anti-ICOS Fab-Fc antibodies. CDRs are underlined and slashes indicate the border(s) of variable regions. These are referred to as "one-arm" or "one armed" formats as one amino acid chain is only an Fc domain, with the other side being an anti-ICOS Fab side. The Fc domain contains the S364K/E357Q skew variants, as well as the pI(−)_Isosteric_A variants depicted in Figure X. The Fab Fc domain contains the L368D/K370S skew variants as well as the pI ISO(+RR) variants depicted in Figure X. Both Fc domains include the ablation variants (E233P/L234V/L235A/G236del/S267K).

FIG. 69 depicts equilibrium dissociation constants (KD), association rates (ka), and dissociation rates (kd) of variant one-arm anti-ICOS Fab-Fc antibodies for murine Fc fusions of human ICOS captured on AMC biosensors as determined by Octet.

Figure 70:
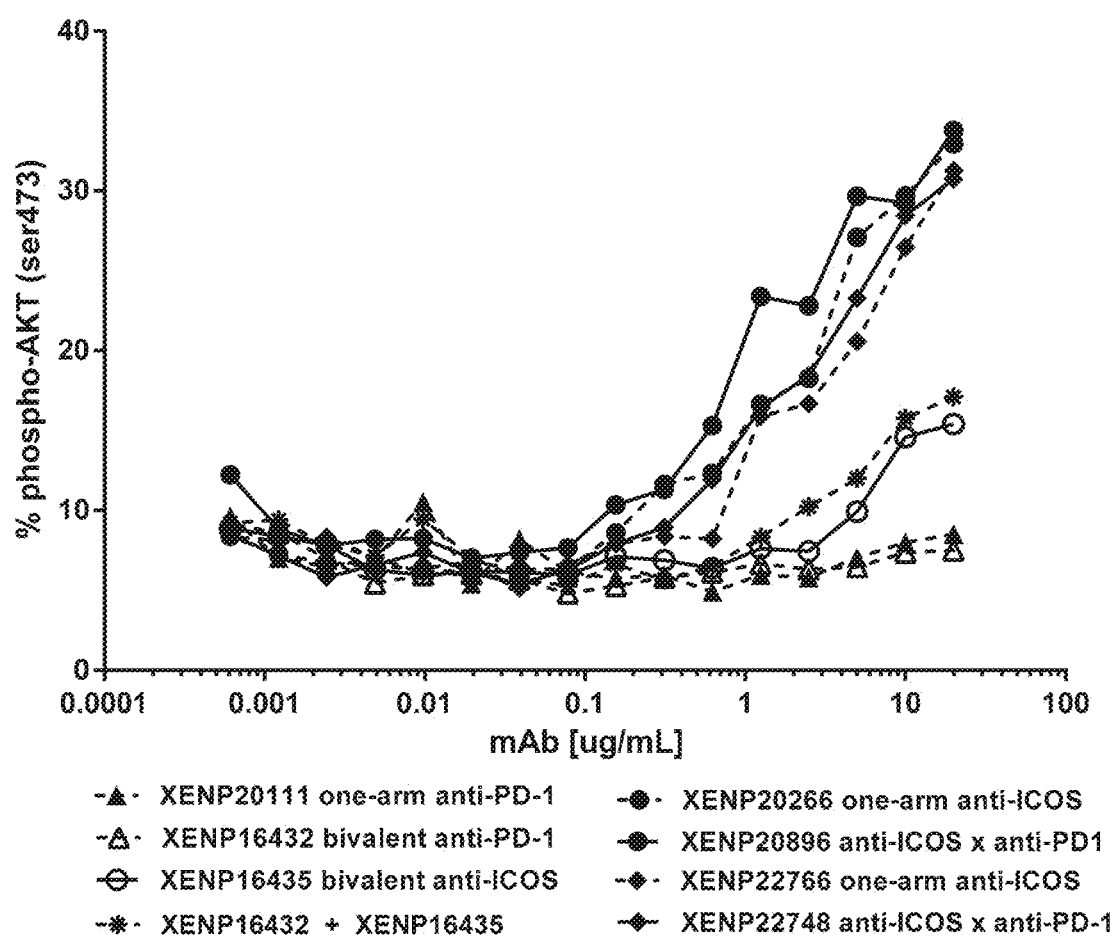

FIG. 70 depicts AKT phosphorylation in SEB-stimulated purified CD3+ T cells after treatment with bivalent and monovalent anti-PD-1 antibodies and anti-ICOS x anti-PD-1 bispecific antibodies.

Figure 71:
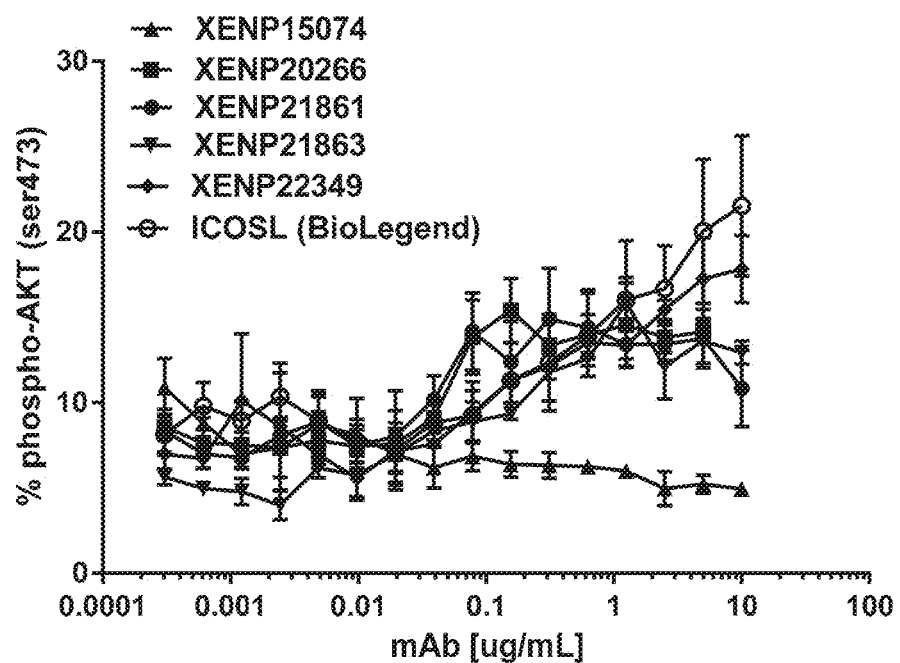

FIG. 71 depicts AKT phosphorylation in purified CD3+ T cells after treatment with monovalent anti-ICOS Fab-Fc antibodies with alternative anti-ICOS ABDs.

FIG. 72A to 72C depict some prototype bispecific antibodies (OX40 X PD-1, GITR X PD-1, 4-1BB X PD-1, CTLA-4 X ICOS).

FIG. 73A to 73H depict some prototype mAbs (4-1BB, OX40, GITR, ICOS, PD-L1 and PD-1), the Fvs of which can be used in combination with the other Fvs of the invention and in any format (bottle opener, mAb-Fv, mAb-scFv, central-scFv, bispecific mAb, central-Fv, one armed central-scFv, one armed scFv-mAb, dual scFv, DVD-Ig or Trident). Some additional ICOS X PD-L1 bottle opener sequences are shown as well.

FIG. 74A to 74F depict additional PD-1 X ICOS bottle openers, in some cases with the PD-1 Fv being in the Fab format and the ICOS Fv in a scFv format and in other cases reversed.

FIG. 75A to 75D shows the sequences of a mAb-scFv backbone of use in the invention, to which the Fv sequences of the invention are added. mAb-scFv backbone 1 is based on human IgG1 (356E/358M allotype), and includes the S364K/E357Q: L368D/K370S skew variants, the N208D/Q295E/N384D/Q418E/N421D pI variants on the Fab side and the E233P/L234V/L235A/G236del/S267K ablation variants on both chains. Backbone 2 is based on human IgG1 (356D/358L allotype), and includes the S364K/E357Q: L368D/K370S skew variants, the N208D/Q295E/N384D/Q418E/N421D pI variants on the Fab side and the E233P/L234V/L235A/G236del/S267K ablation variants on both chains. Backbone 3 is based on human IgG1 (356E/358M allotype), and includes the S364K/E357Q: L368D/K370S skew variants, N208D/Q295E/N384D/Q418E/N421D pI variants on the Fab side and the E233P/L234V/L235A/G236del/S267K ablation variants on both chains, as well as an N297A variant on both chains. Backbone 4 is identical to 3 except the mutation is N297S. Alternative formats for mAb-scFv backbones 3 and 4 can exclude the ablation variants E233P/L234V/L235A/G236del/S267K in both chains. Backbone 5 is based on human IgG4, and includes the S364K/E357Q:L368D/K370S skew variants, the N208D/Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art Backbone 6 is based on human IgG2, and includes the S364K/E357Q: L368D/K370S skew variants, the N208D/Q295E/N384D/Q418E/N421D pI variants on the Fab side. Backbone 7 is based on human IgG2, and includes the S364K/E357Q: L368D/K370S skew variants, the N208D/Q295E/N384D/Q418E/N421D pI variants on the Fab side as well as a S267K variant on both chains.

As will be appreciated by those in the art and outlined below, these sequences can be used with any vh and vl pairs outlined herein, with one monomer including both a Fab and an scFv (optionally including a charged scFv linker) and the other monomer including the Fab sequence (e.g. a vh attached to the "Fab side heavy chain" and a vl attached to the "constant light chain"). That is, any Fv sequences outlined herein for anti-CTLA-4, anti-PD-1, anti-LAG-3, anti-TIM-3, anti-TIGIT, anti-BTLA, anti-ICOS, anti-GITR, anti-OX40 and anti-4-1BB, whether as scFv (again, optionally with charged scFv linkers) or as Fabs, can be incorporated into this FIG. 75 backbone in any combination. The monomer 1 side is the Fab-scFv pI negative side, and includes the heterodimerization variants L368D/K370S, the isosteric pI variants N208D/Q295E/N384D/Q418E/N421D, the ablation variants E233P/L234V/L235A/G236del/S267K, (all relative to IgG1). The monomer 2 side is the scFv pI positive side, and includes the heterodimerization variants 364K/E357Q. However, other skew variant pairs can be substituted, particularly [S364K/E357Q: L368D/K370S]; [L368D/K370S: S364K]; [L368E/K370S: S364K]; [T411T/E360E/Q362E: D401K]; [L368D/K370S: S364K/E357L], [K370S: S364K/E357Q], [T366S/L368A/Y407V: T366W] and [T366S/L368A/Y407V/Y394C: T366W/S354C].

The constant light chain depicted in FIG. 75A can be used for all of the constructs in the figure, although the kappa constant light chain can also be substituted.

It should be noted that these mAb-scFv backbones find use in the both the mAb-Fv format of FIG. 1H (where one monomer comprises a vl at the C-terminus and the other a vh at the C-terminus) as well as the scFv-mAb format (with a scFv domain added to the C-terminus of one of the monomers).

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 76A to 76F depict a number of prior art sequences for Fvs that bind human PD-1 as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]H0.66_L0 ABDs.

FIGS. 77A and 77B depict a number of prior art sequences for Fvs that bind human ICOS as vh and vl sequences. As will be appreciated by those in the art, any of these Fvs can be combined with an Fv that binds a checkpoint receptor (e.g. PD-1, PD-L1, CTLA-4, TIM-3, LAG-3, TIGIT and BTLA, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with PD-1 ABDs having the identifiers 1G6_H1.279_L1.194; 1G6_H1.280_L1.224; 1G6_L1.194_H1.279; 1G6_L1.210_H1.288; and 2E9_H1L1.

FIG. 78A to 78J depict a number of prior art sequences for Fvs that bind human PD-L1 as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]_H0.66 L0 ABDs.

FIGS. 79A and 79B depict a number of prior art sequences for Fvs that bind human CTLA-4 as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]_H0.66 L0 ABDs.

FIG. 80A to 80C depict a number of prior art sequences for Fvs that bind human LAG-3 as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]H0.66_L0 ABDs.

FIG. 81A to 81C depict a number of prior art sequences for Fvs that bind human TIM-3 as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]_H0.66_L0 ABDs.

FIG. 82 depict a number of prior art sequences for Fvs that bind human BTLA as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]H0.66_L0 ABDs.

FIG. 83A to 83D depict a number of prior art sequences for Fvs that bind human TIGIT as vh and vl sequences. As will be appreciated by those in the art, any of these Fvs can be combined with an Fv that binds a costimulatory receptor (e.g. ICOS, GITR, OX40 or 4-1BB, including the Fv sequences contained herein) and in any format (bottle opener, mAb-Fv, mAb-scFv, central-scFv, bispecific mAb, central-Fv, one armed central-scFv, one armed scFv-mAb, dual scFv, DVD-Ig or Trident). In particular they can be combined with ICOS]_H0L0 and [ICOS]H0.66_L0 ABDs.

FIG. 84A to 84C depict a number of BTLA ABDs, with additional anti-BTLA ABDs being listed as SEQ ID NO: 3705-3736. The CDRs are underlined, the scFv linker is double underlined (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains. As above, the naming convention illustrates the orientation of the scFv from N- to C-terminus;

in the sequences listed in this figure, they are all oriented as vh-scFv linker-vl (from N- to C-terminus), although these sequences may also be used in the opposite orientation, (from N- to C-terminus) vl-linker-vh. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 85 is a matrix of possible combinations of the costim and checkpoint ABDs, with all possible combinations possible. An "A" in the box means that the PD-1 ABD is 1G6_L1.194_H1.279. A "B" in the box means that the ICOS ABD is [ICOS]H.066_L0. A "C" in the box means that the PD-1 is the scFv in the pair. A "D" in the box means the CTLA-4 ABD is a Fab and is [CTLA-4]_H3_L0.22. An "E" in the box means that the CTLA-4 ABD is a scFv and is [CTLA-4]_H3.23_L0.22. An "F" in the box means that the LAG-3 ABD is 7G8_H3.30_L1.34. A "G" in the box means that the BTLA ABD is 9C6_H1.1_L1. An "H" in the box means that combination is a bottle opener. An "I" in the box means the combination is Central-scFv format.

FIG. 86 depicts two more ICOS X PD-1 bottle openers.

Figure 87A:
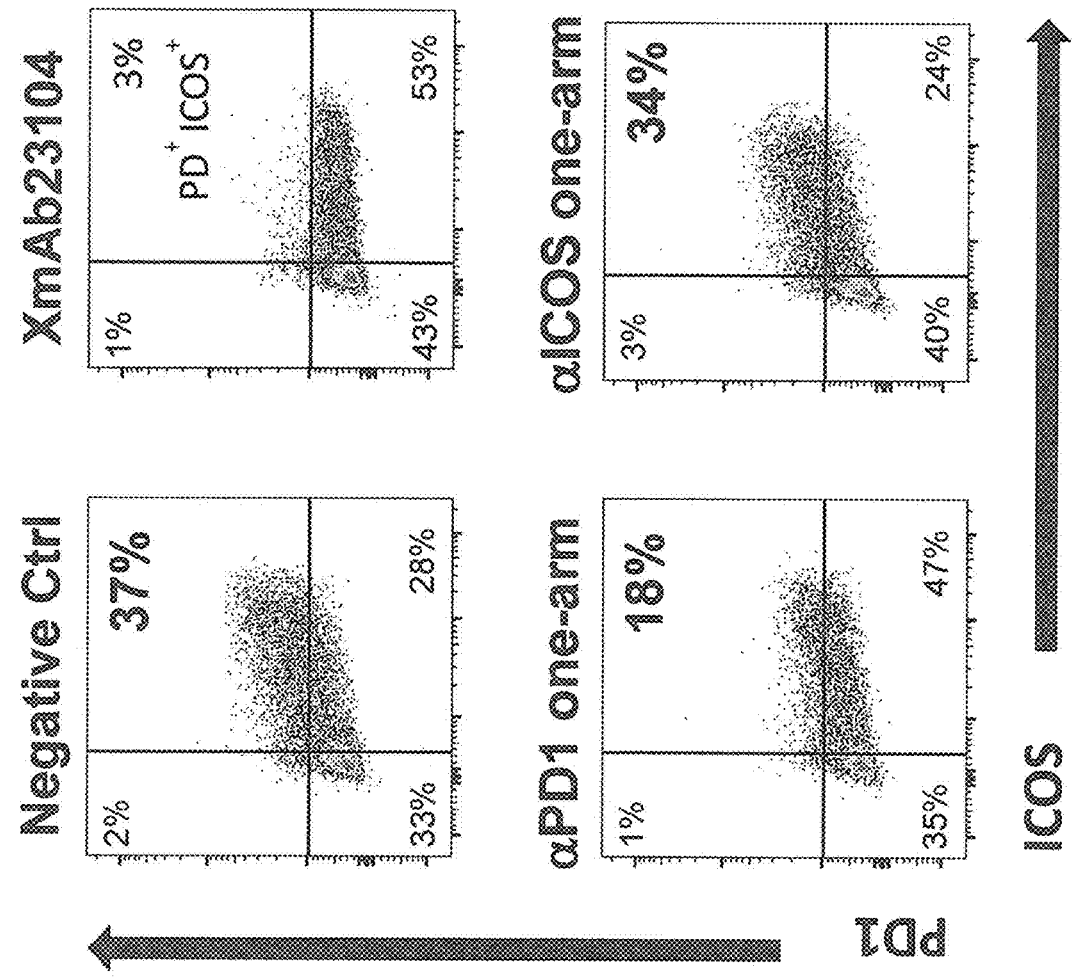
Figure 87B:
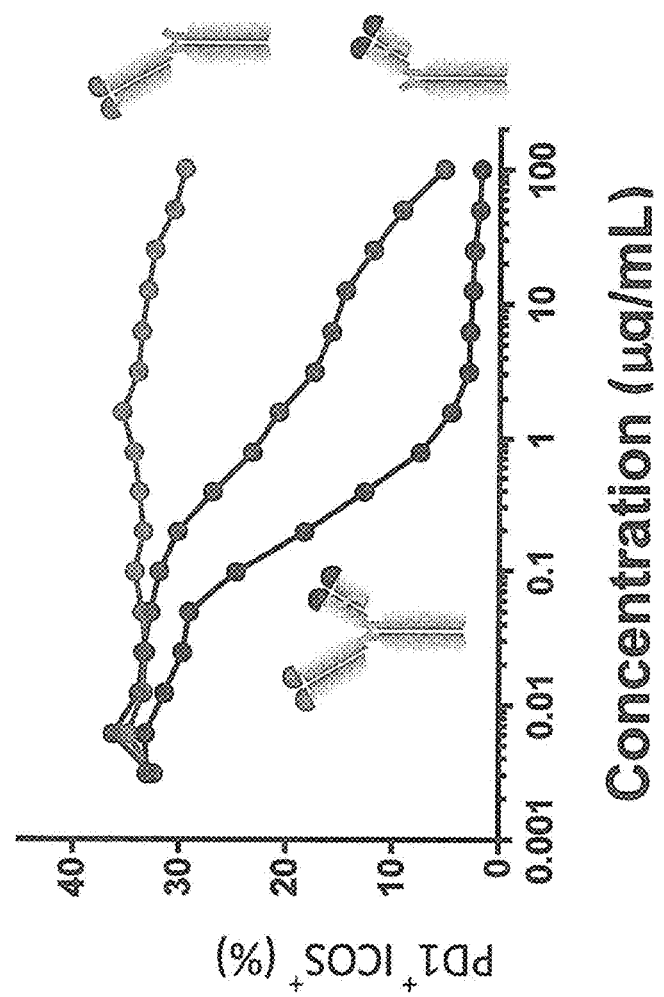

FIGS. 87A and 87B depicts that monovalent engagement of PD-1 and ICOS enables avid targeting of double positive T cells; receptor occupancy of PD1 and ICOS on human CD3+T cells stimulated with SEB. Scatterplots are shown for 3 ug/mL concentration.

Figure 88:
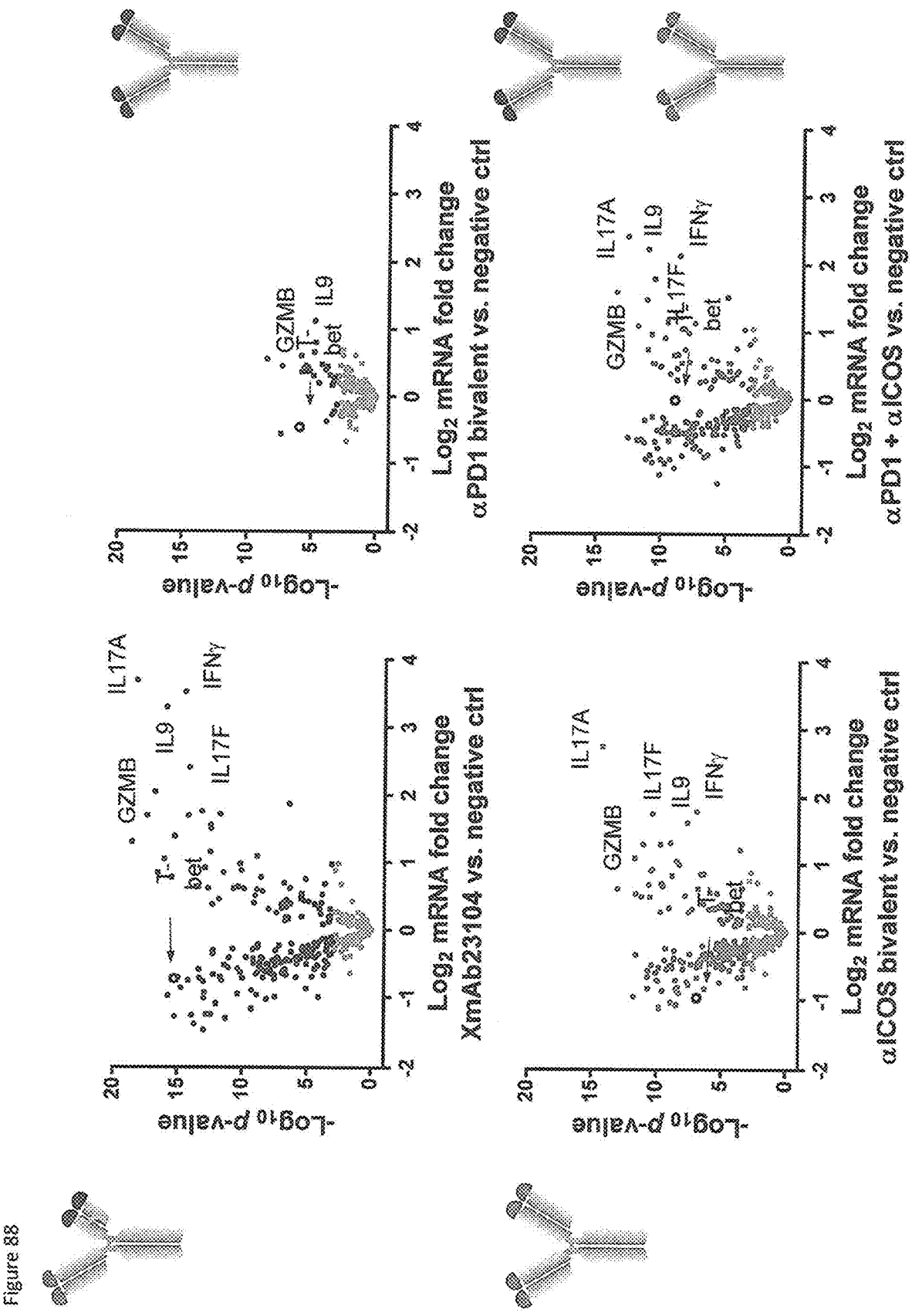

FIG. 88 depicts that XmAb23104 exhibits a multi-gene expression signature consistent with ICOS co-stimulation. SEB-stimulated human PBMCs (multiple healthy donors). RNA analyzed on a NanoString platform as described herein using the nCountrer PanCancer Immune Profiling Panel.

Figure 89:
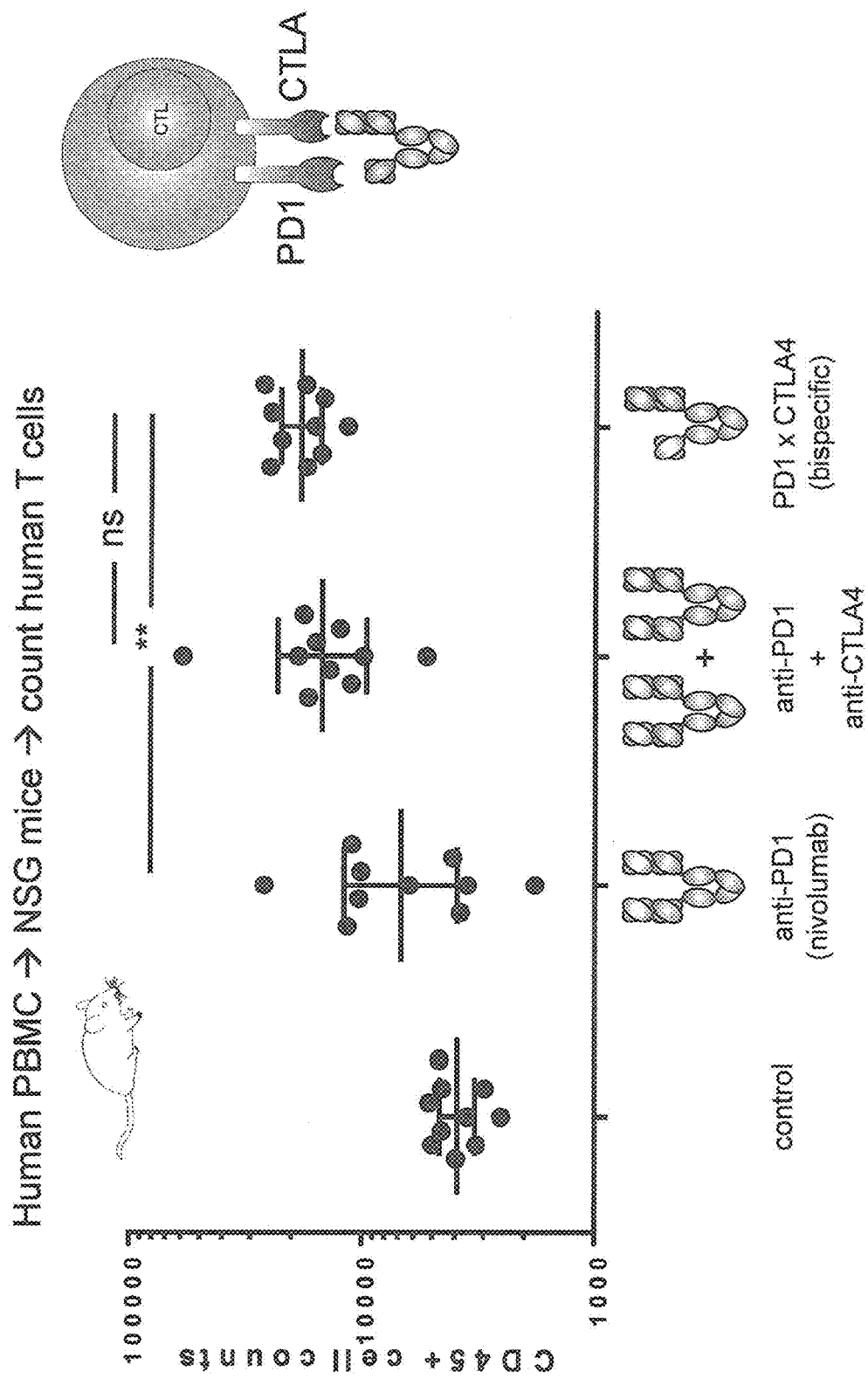

FIG. 89 shows the PD1 X CTLA4 bispecific antibody is highly active in a mouse model for checkpoint blockade.

Figure 90:
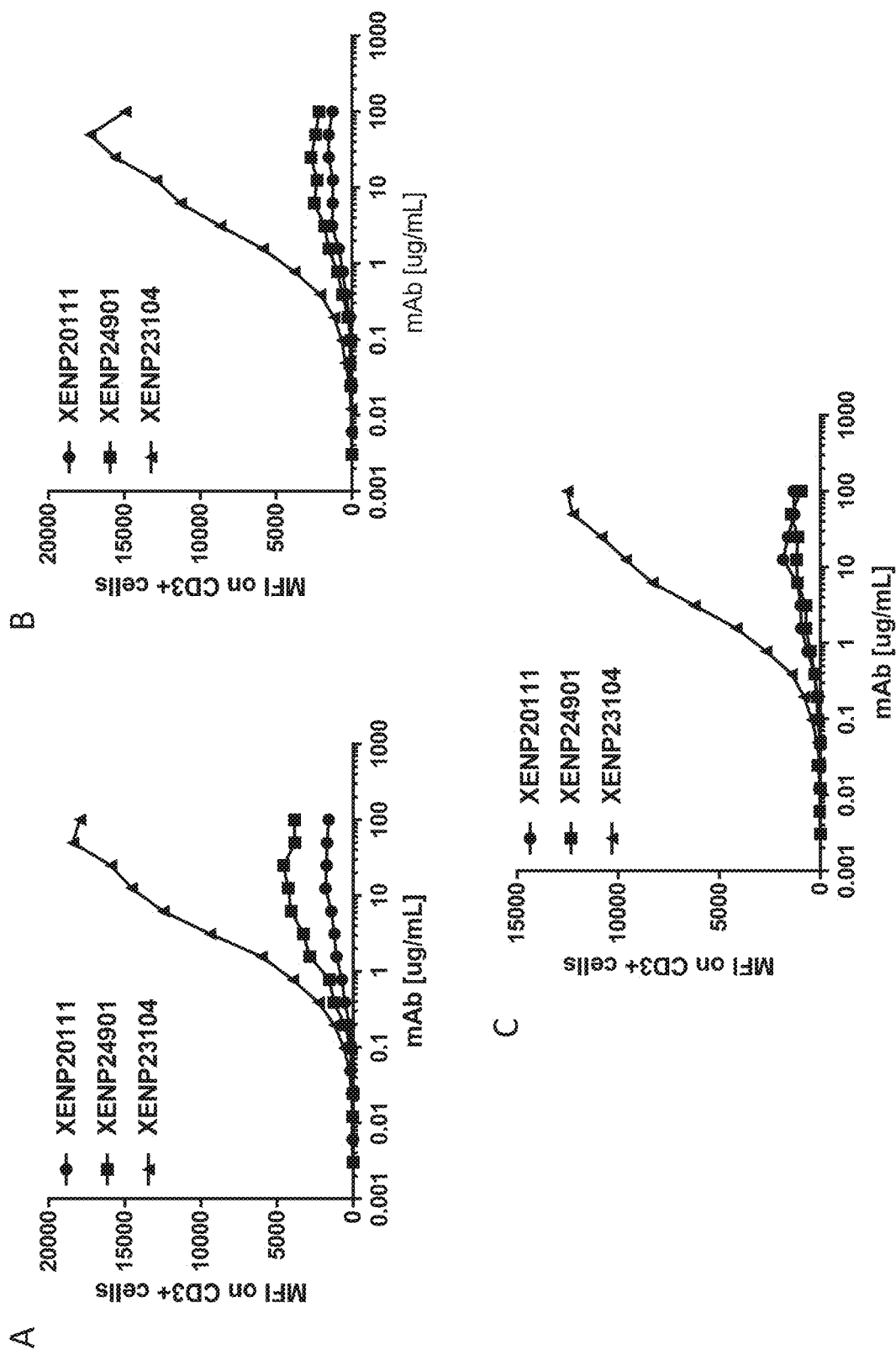

FIG. 90 depicts binding of the indicated test articles to SEB-stimulated CD3+ T cells from 3 separate PBMC donors (A-C).

Figure 91:
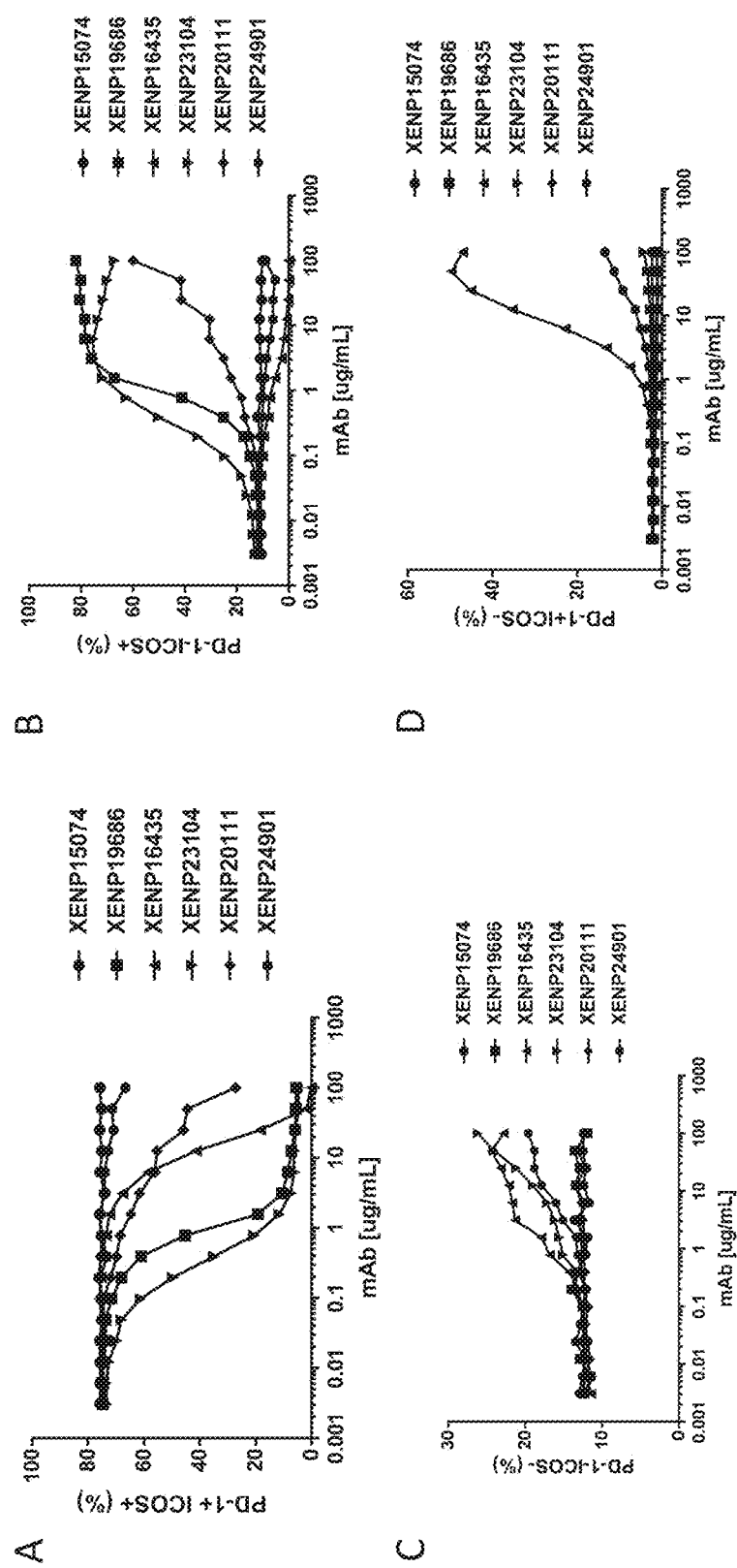

FIG. 91 depicts checkpoint receptor occupancy by the indicated test articles as indicated by percentage of populations of SEB-stimulated CD3+ T cells with unoccupied PD-1 and/or ICOS receptors as shown by staining.

Figure 92:
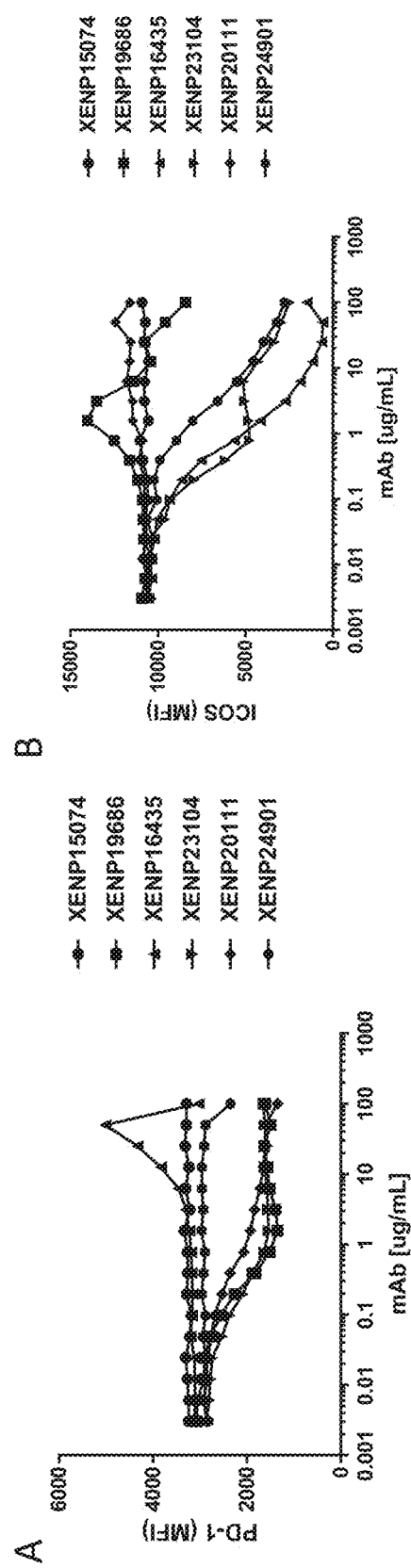

FIG. 92 shows the amount of unoccupied A) PD-1 and B) ICOS receptors on CD3+ICOS+PD-1+ SEB-stimulated T cells following treatment with the indicated test articles.

Figure 93:
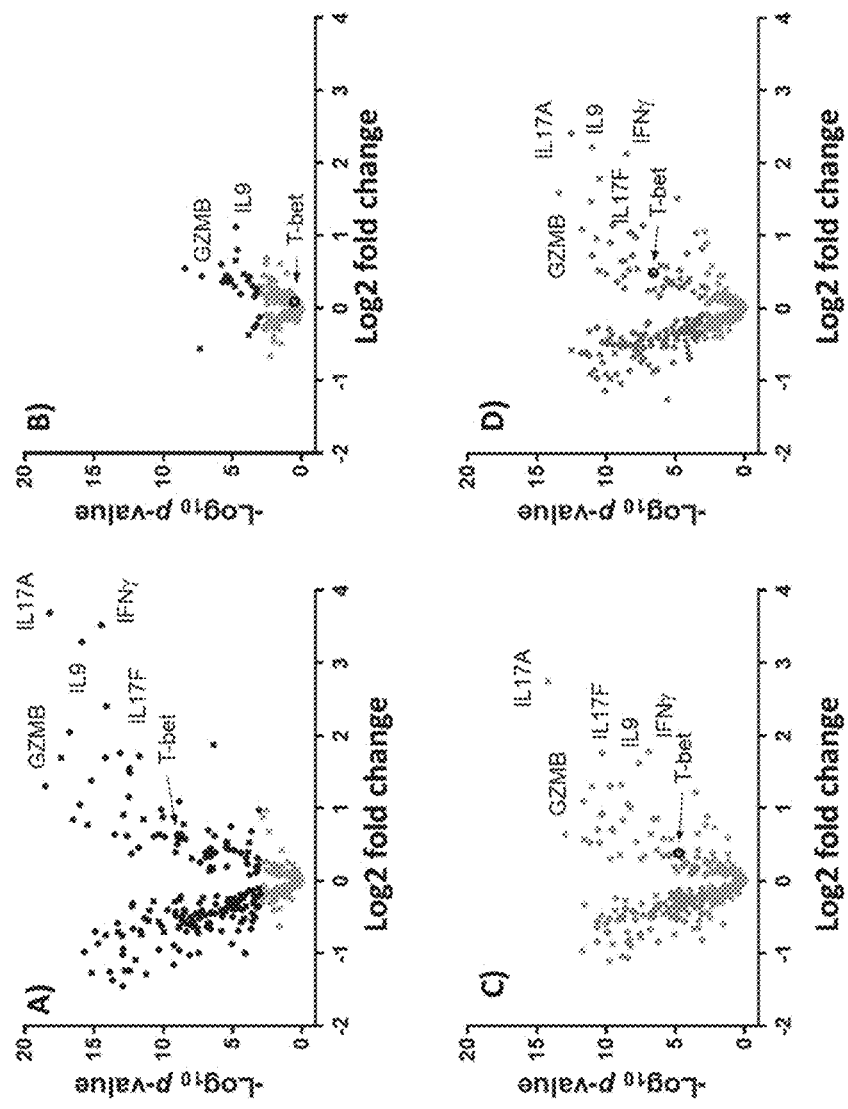

FIG. 93 depicts fold change (x-axis) in expression of immune-related genes by SEB-stimulated T cells following treatment with A) XmAb23104, B) anti-PD-1 mAb (XENP19686), C) anti-ICOS mAb (XENP16435), and D) anti-PD-1 mAb (XENP19686) in combination with anti-ICOS mAb (XENP16435) over treatment with negative control anti-RSV mAb (XENP15074).

Figure 94:
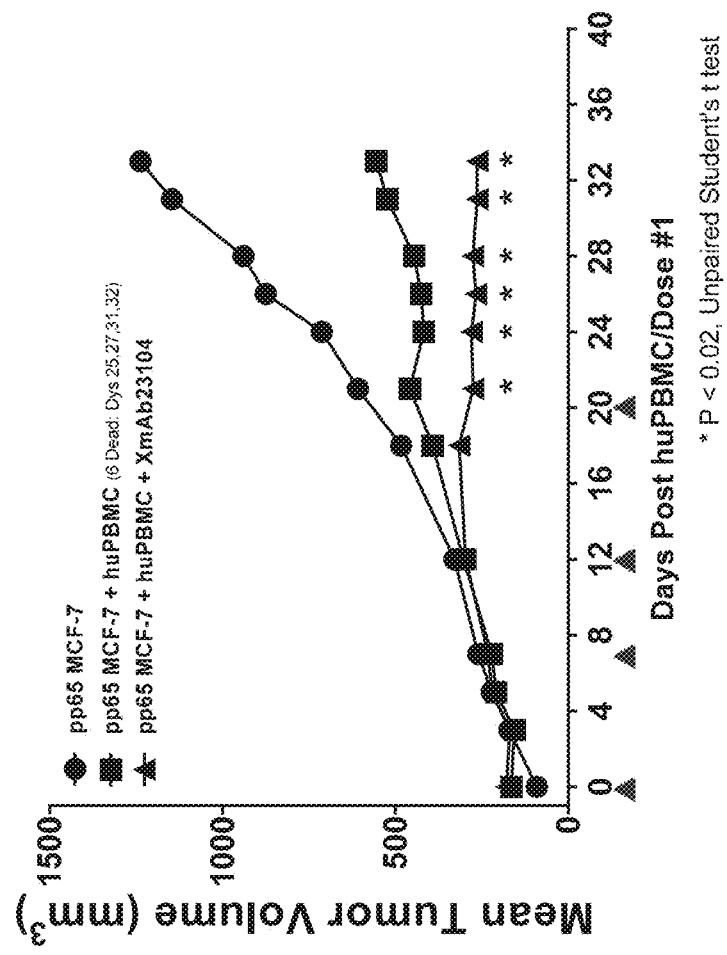

FIG. 94 depicts tumor burden (as indicated by mean tumor volume as determined by caliper measurements) in NSG mice engrafted with pp65-expressing MCF-7 cells followed by engraftment with huPBMCs following treatment with XmAb23104. Triangles below the X-axis indicate dosing days.

Figure 95:
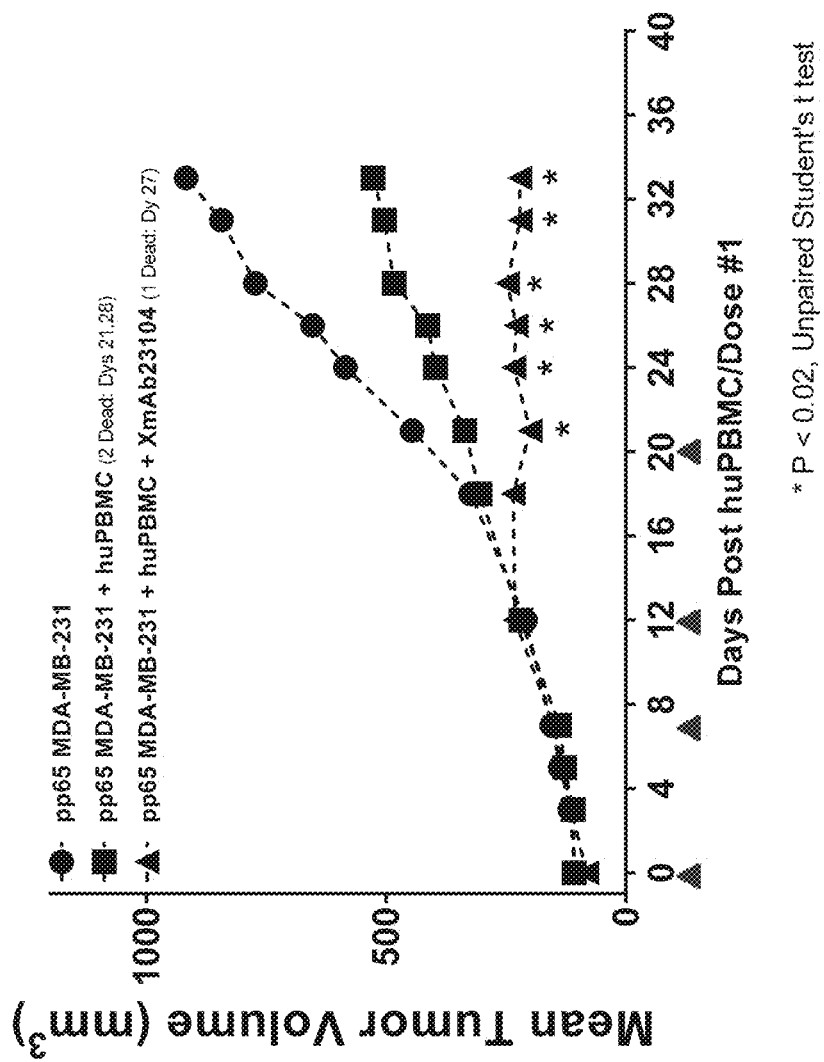

FIG. 95 depicts tumor burden (as indicated by mean tumor volume as determined by caliper measurements) in NSG mice engrafted with pp65-expressing MDA-MB-231 cells followed by engraftment with huPBMCs following treatment with XmAb23104. Triangles below the X-axis indicate dosing days.

FIG. 96 depicts the amino acid sequences of a monovalent anti-ICOS Fab-Fc fusion based on the anti-ICOS arm from XmAb23104 with M428L/N434S Xtend Fc. CDRs are underlined and slashes indicate the border(s) of the variable regions.

FIG. 97 depicts the sequences for A) human PD-L1 and B) human PD-L2 fused to murine IgG2aa Fc region. Slashes (/) indicate the border between the PD-1 ligand and the murine IgG2aa Fc-region.

Figure 98A:
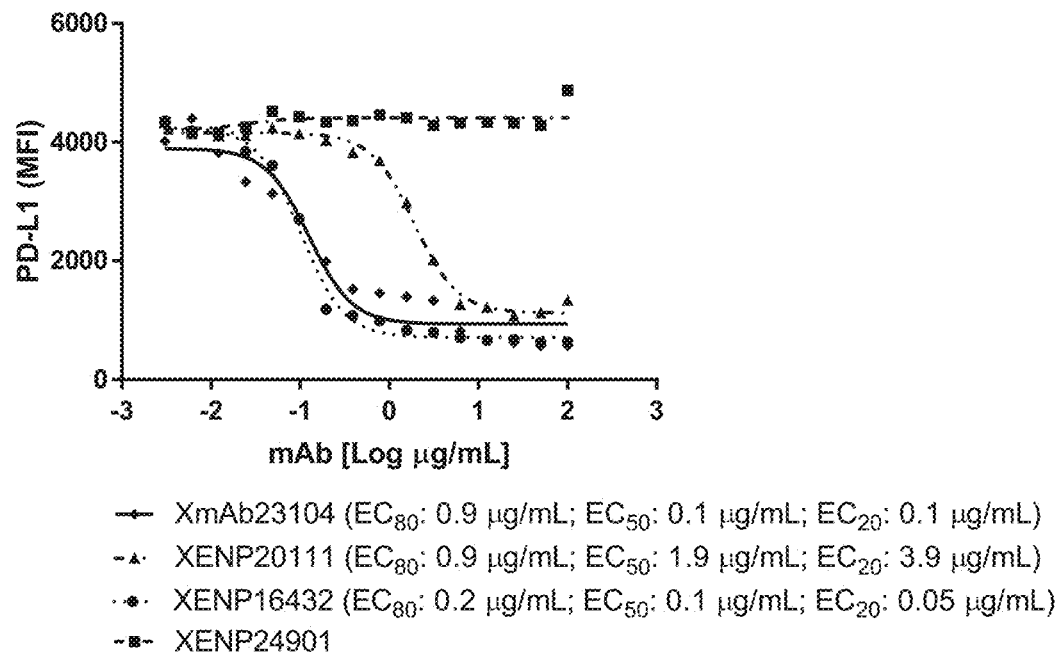
Figure 98B:
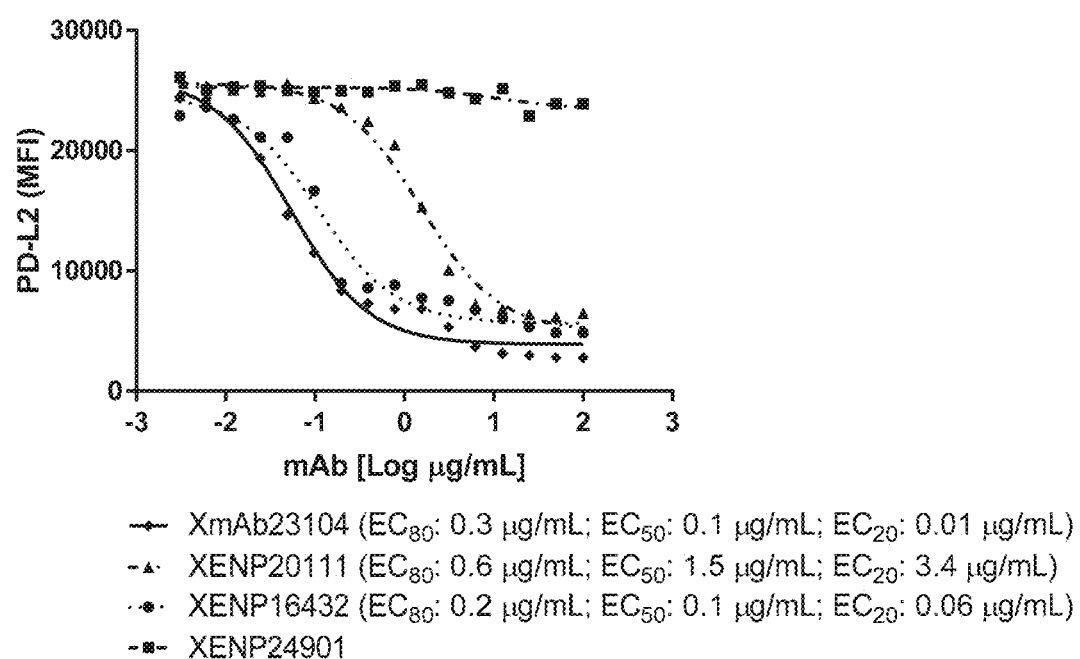
Figure 101A:
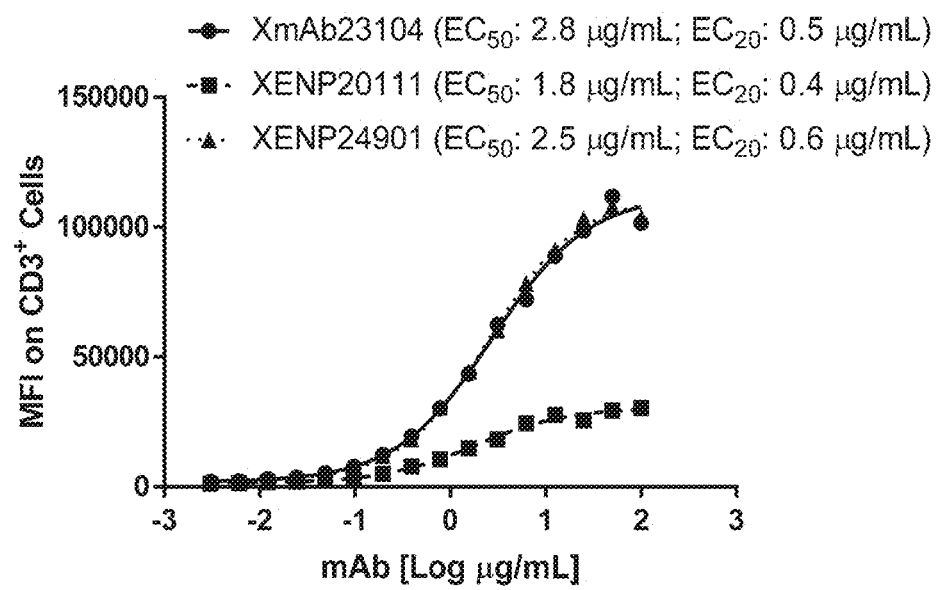
Figure 101B:
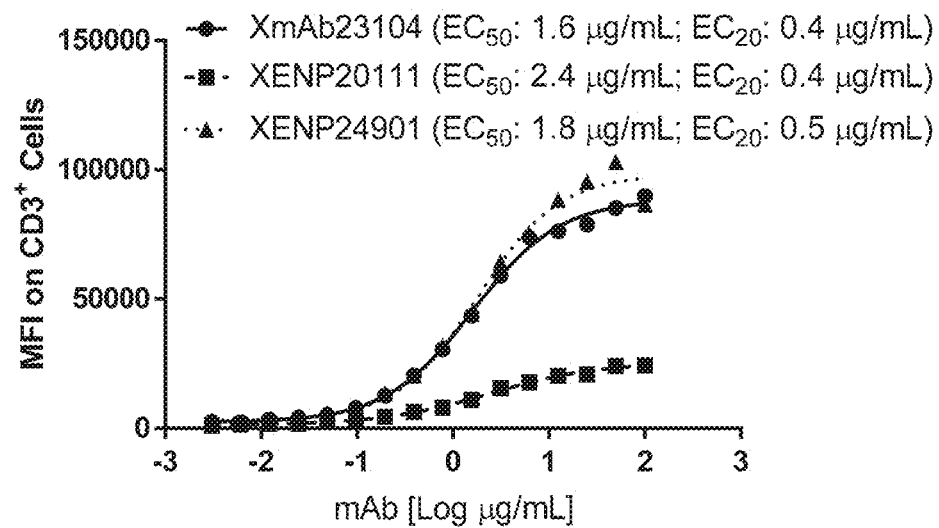
Figure 101C:
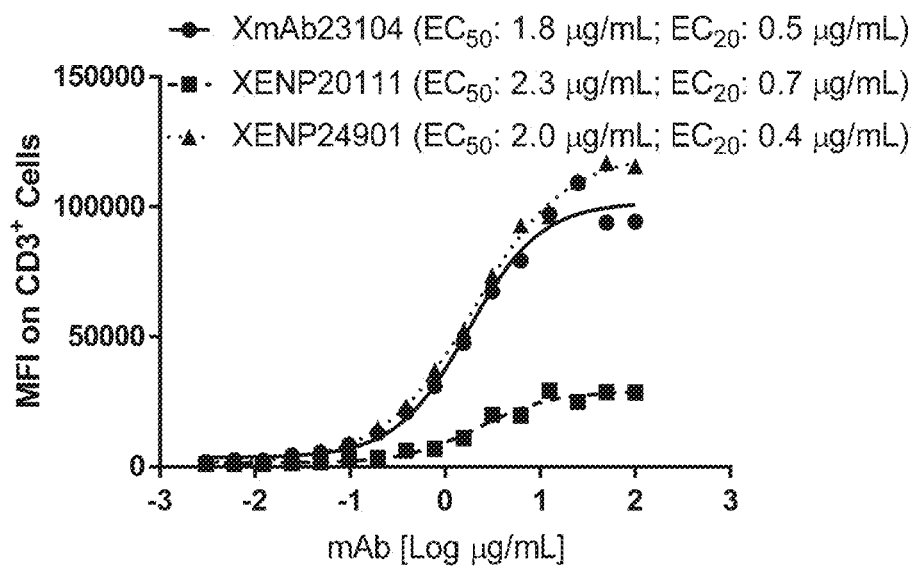
Figure 101D:
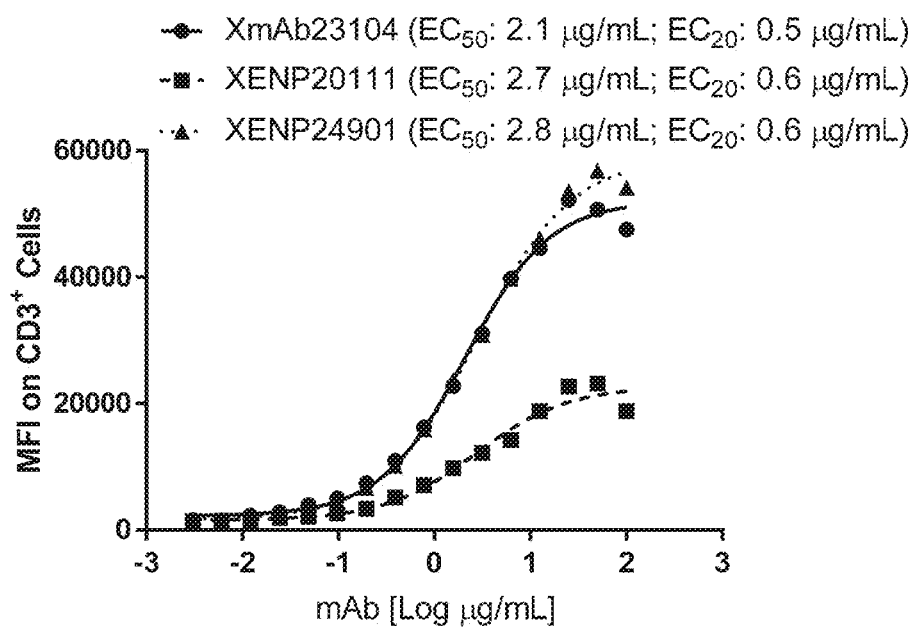

FIGS. 98A and B depicts binding of A) PD-L1 and B) PD-L2 to PD-1+ICOS+ cells following treatment with the indicated test articles.

FIG. 99 depicts the sequence for human ICOSL fused to human IgG1 Fc region with E233P/L234V/L235A/G236del/S267K substitutions. Slashes (/) indicate the border between the PD-1 ligand and the human IgG1 Fc-region.

FIG. 100 depicts binding of ICOSL to PD-1+ICOS+ cells following treatment with the indicated test articles.

FIG. 101A to 101D depicts binding of XmAb23104 to CD3+ T cells in SEB-stimulated PBMCs from 4 cynomolgus monkeys.

Figure 102A:
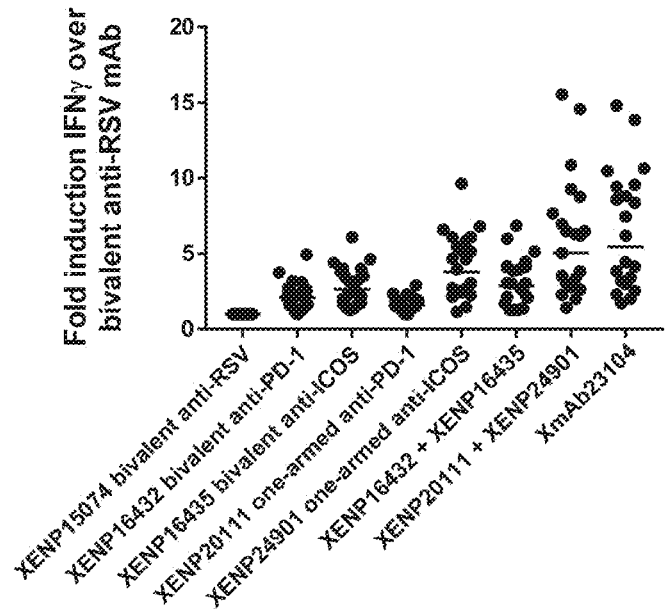
Figure 102B:
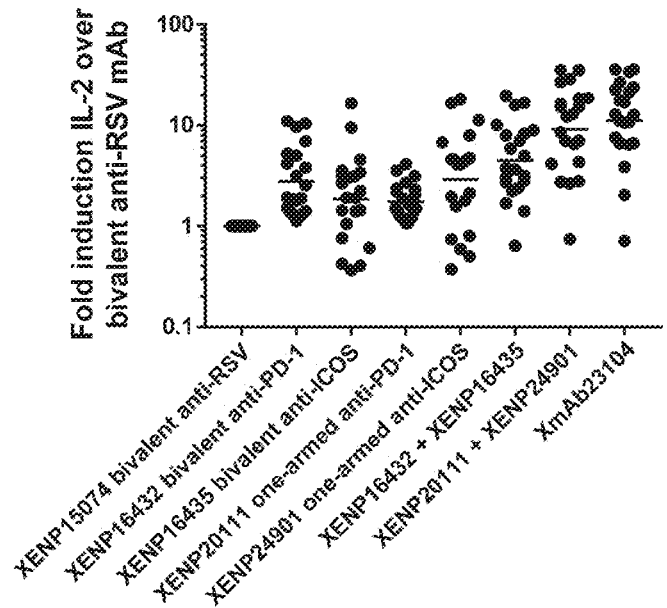

FIGS. 102A and 102B depicts fold induction of A) IFNγ and B) IL-2 over bivalent anti-RSV mAb by the indicated test articles in an SEB-stimulated PBMC assay.

Figure 103:
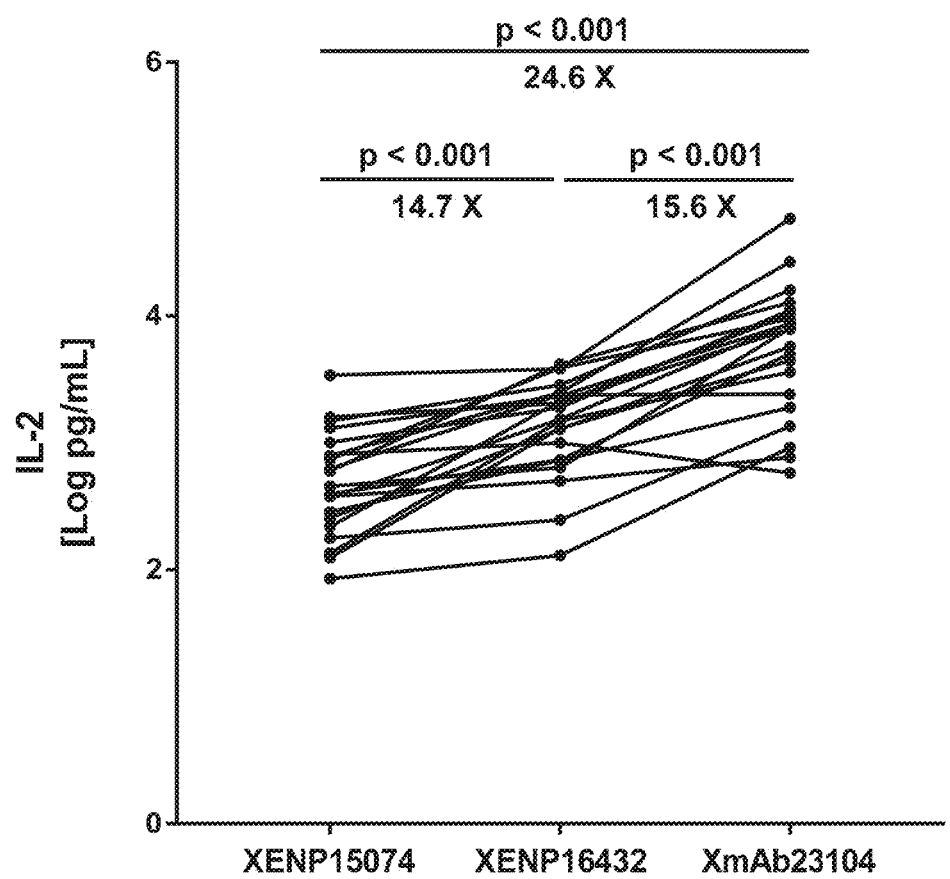

FIG. 103 depicts IL-2 induction by XENP15074, XENP16432, and XmAb23104 in an SEB-stimulated PBMC assay.

FIG. 104 depicts the amino acid sequences of a monovalent anti-PD-1 scFv-Fc fusion based on the anti-PD-1 arm from XmAb23104 with M428L/N424S Xtend Fc. CDRs are underlined and slashes indicate the border(s) of the variable regions.

FIG. 105 depicts fold induction of IFNγ over bivalent anti-RSV mAb by the indicated test articles in an MLR assay.

Figure 106A:
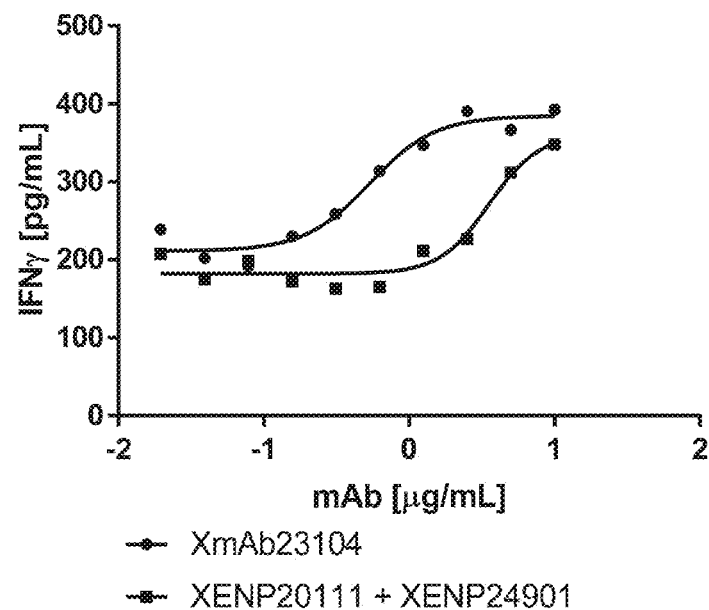
Figure 106B:
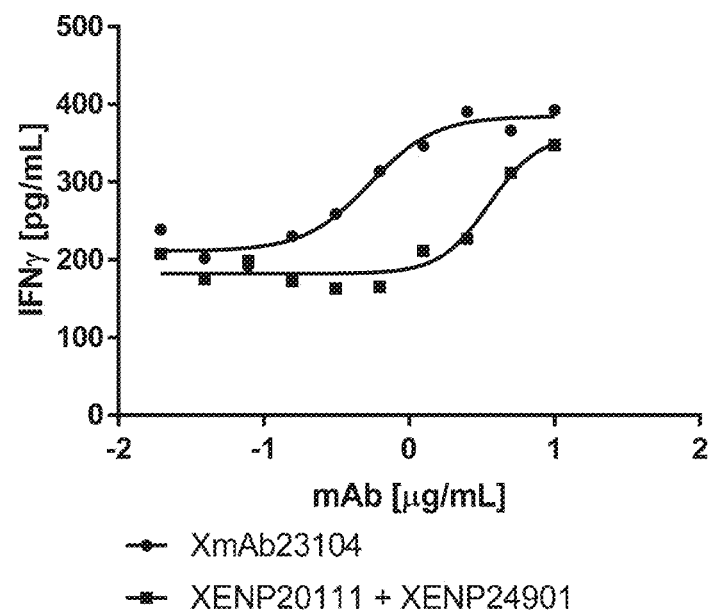

FIGS. 106A and 106B depicts IFNγ induction by XmAb23104 or a combination of XENP20111 and XENP24901 (at equimolar PD-1 and ICOS binding concentrations relative to XmAb23104) in SEB-stimulated PBMCs from 2 separate donors.

Figure 107A:
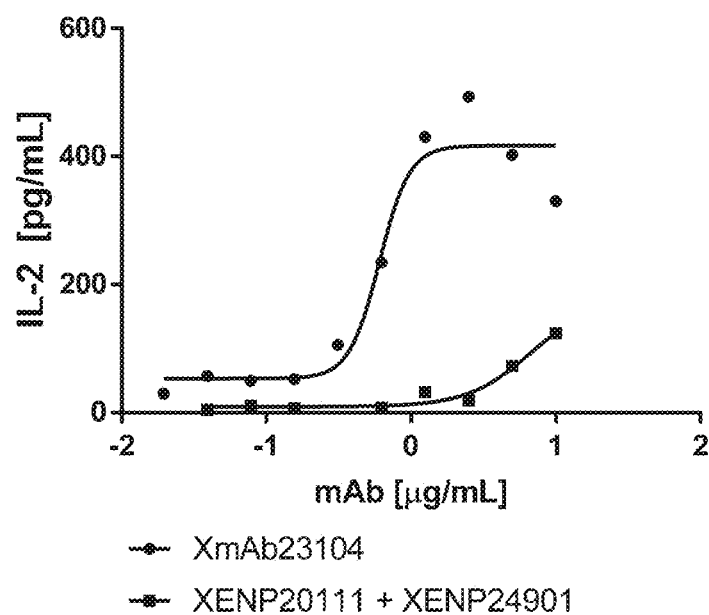
Figure 107B:
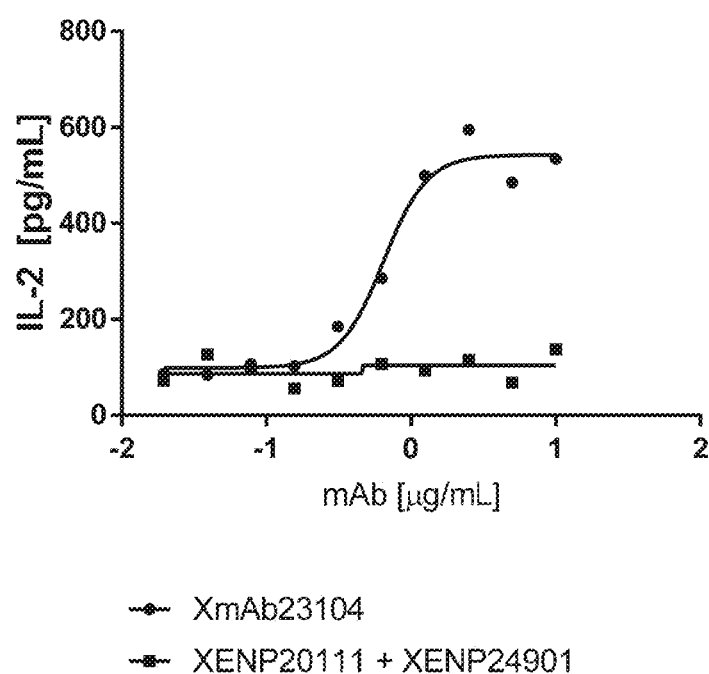

FIGS. 107A and 107B depicts IL-2 induction by XmAb23104 or a combination of XENP20111 and XENP24901 (at equimolar PD-1 and ICOS binding concentrations relative to XmAb23104) in SEB-stimulated PBMCs from 2 separate donors.

FIG. 108 depicts the amino acid sequences of a bivalent anti-CTLA-4 mAb based on ipilimumab and human IgG1 Fc region with E233P/L234V/L235A/G236del/S267K substitutions. CDRs are underlined and slashes indicate the border(s) of the variable regions.

Figure 109A:
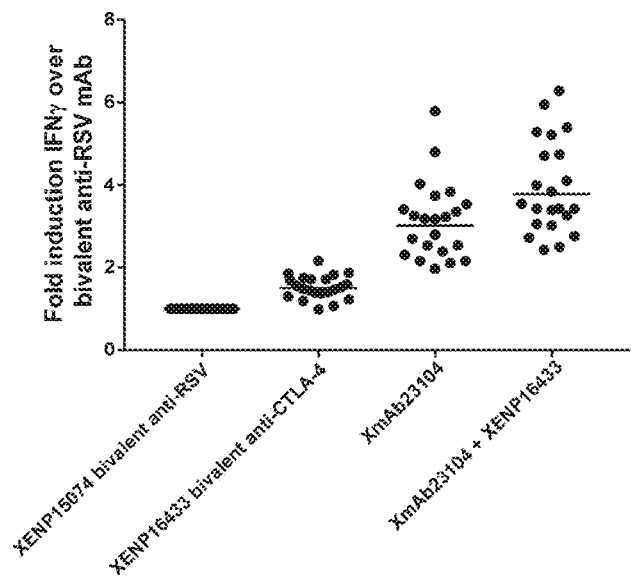
Figure 109B:
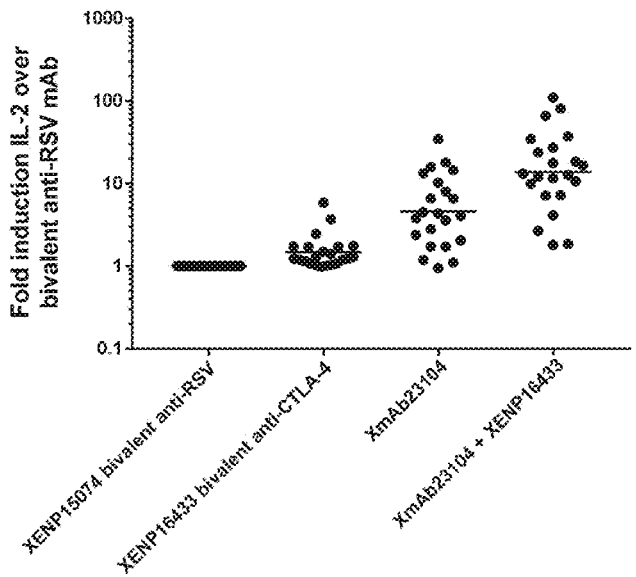

FIGS. 109A and 109B depict fold induction of A) IFNγ and B) IL-2 over bivalent anti-RSV mAb by XmAb23104 alone, XENP16433 (anti-CTLA-4 mAb based on ipilimumab), or XmAb23104 in combination with XENP16433 in an SEB-stimulated PBMC assay.

Figure 110:
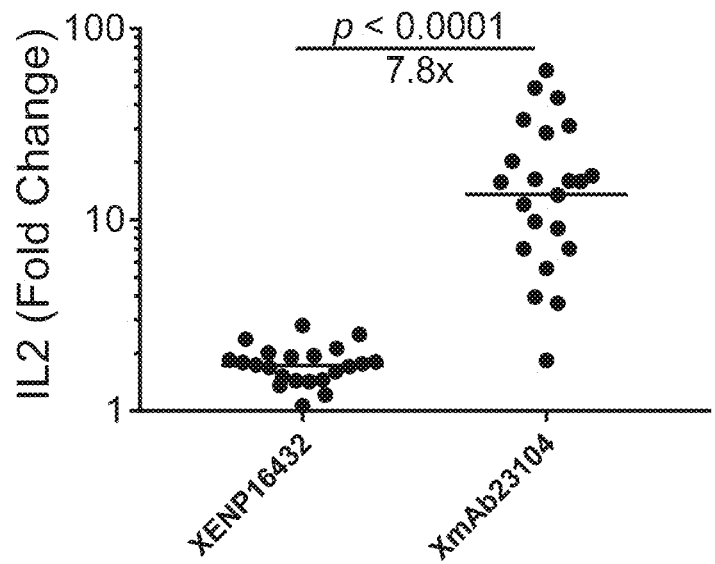

FIG. 110 depicts fold change in IL-2 secretion in MLR reactions incubated with either XENP16432 or XmAb23104 (in comparison to incubation with isotype control anti-RSV mAb).

Figure 111:
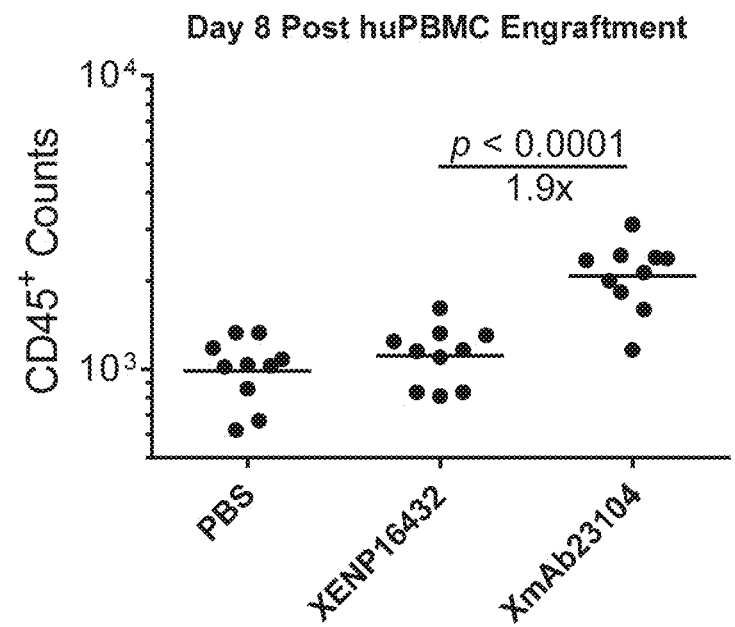

FIG. 111 depicts CD45+ cell counts on Day 8 in huPBMC-engrafted NSG mice dosed with XENP16432 or XmAb23104, and show that XmAb23104 induces greater leukocyte expansion than aPD-1 (XENP16432) alone.

Figure 112:
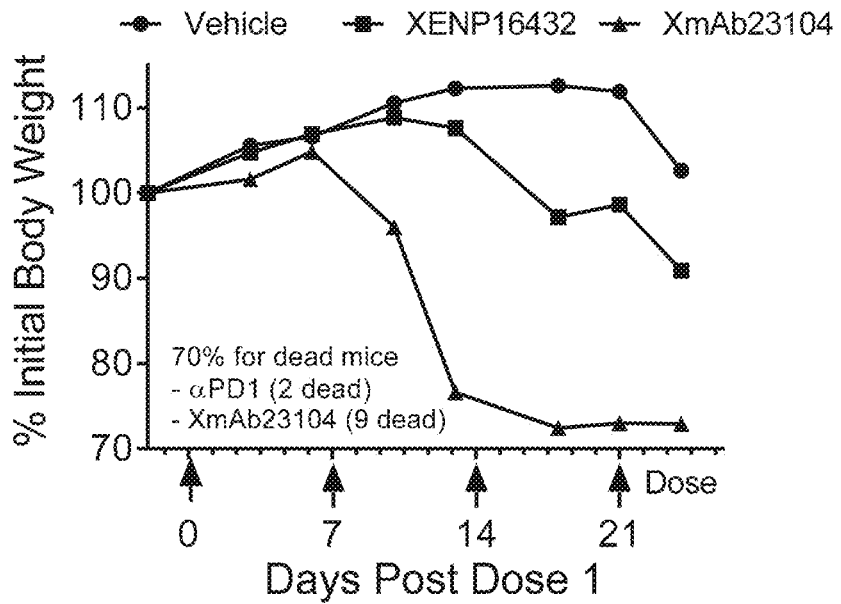

FIG. 112 depicts change in body weight over time in huPBMC-engrafted NSG mice dosed with XENP16432 or XmAb23104, and show that XmAb23104 enhanced GVHD in comparison to aPD-1 (XENP16432) alone.

Figure 113:
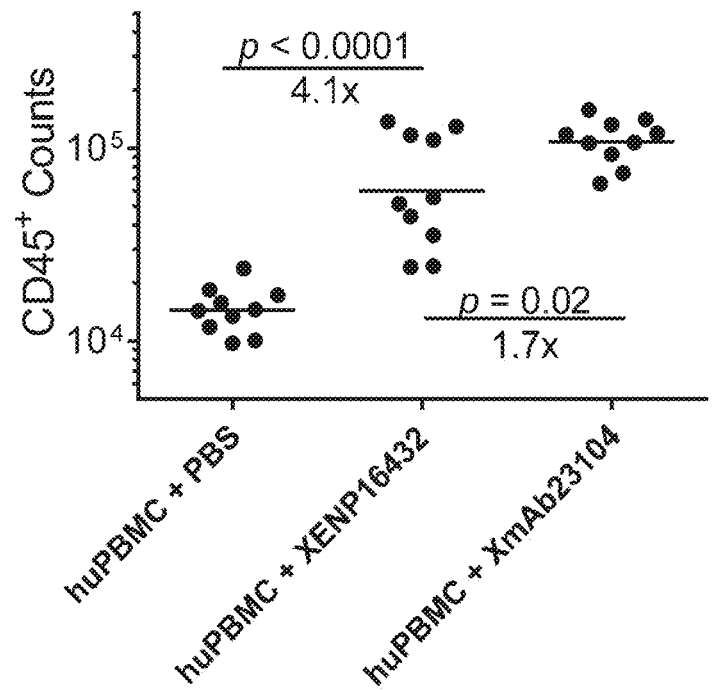

FIG. 113 depicts CD45+ cell counts on Day 21 in pp65-MCF7 and huPBMC-engrafted NSG mice dosed with XENP16432 or XmAb23104, and show that XmAb23104 induces greater leukocyte expansion than aPD-1 (XENP16432) alone.

Figure 114:
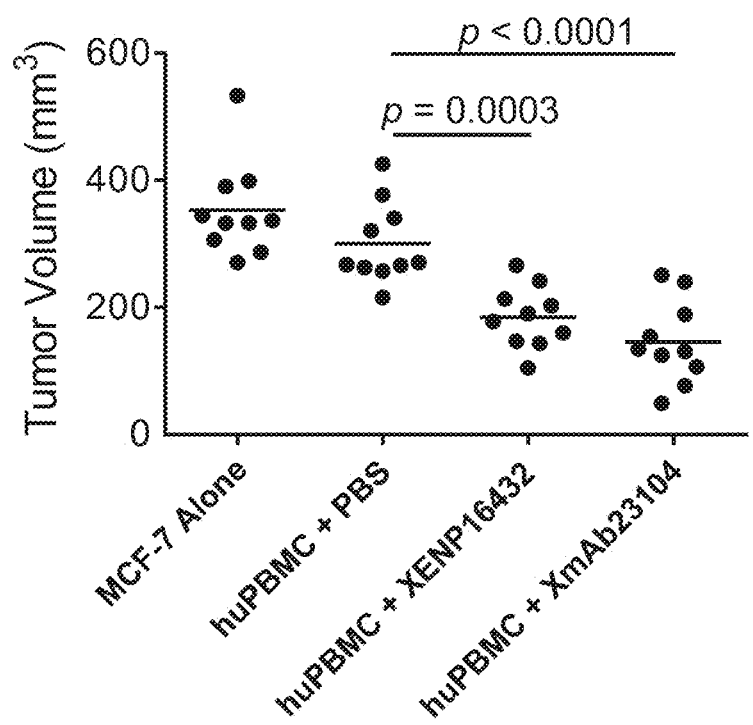

FIG. 114 depicts tumor volume on Day 21 in pp65-MCF7 and huPBMC-engrafted NSG mice dosed with XENP16432 or XmAb23104.

Figure 115:
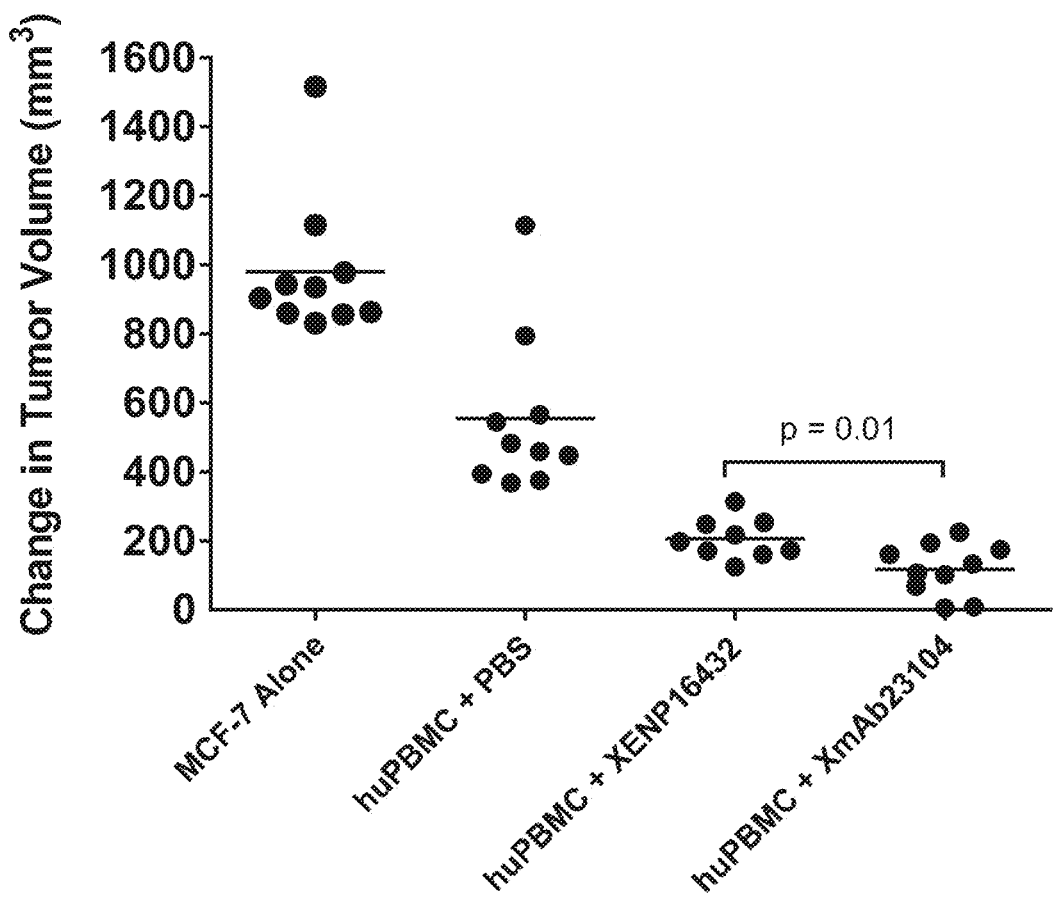

FIG. 115 depicts tumor volume on Day 38 in pp65-MCF7 and huPBMC-engrafted NSG mice dosed with XENP16432 or XmAb23104, and show that XmAb23104 enhances allogeneic anti-tumor response over aPD-1 (XENP16432) alone. p-value was determined using an unpaired t test.

Figure 116:
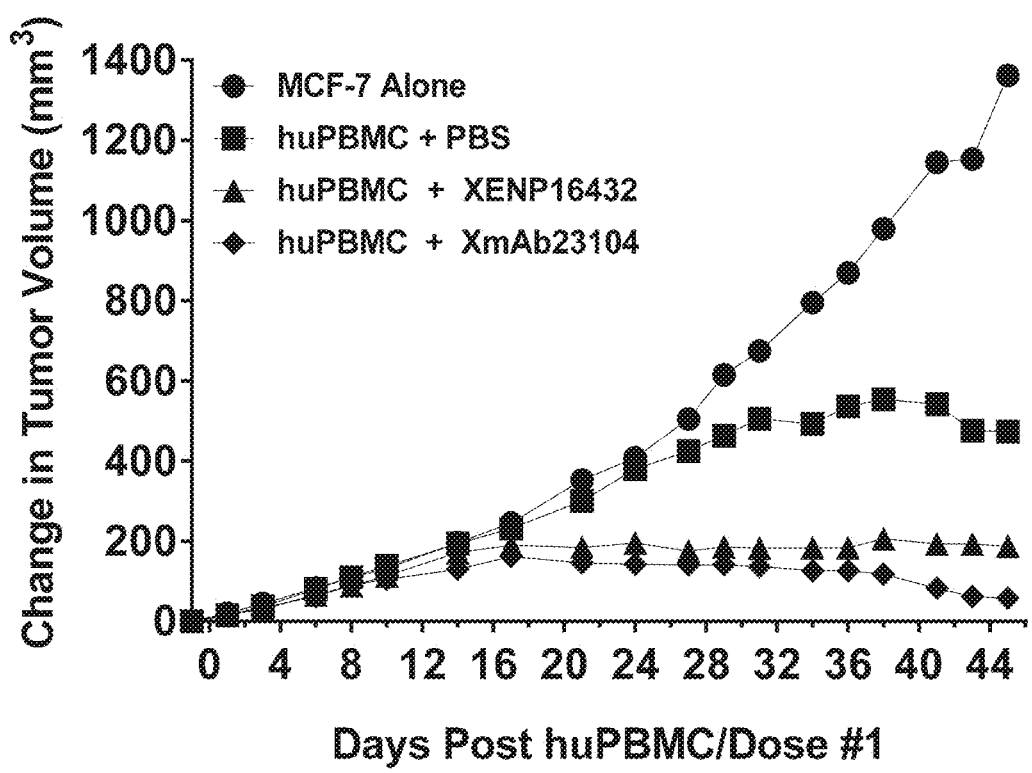

FIG. 116 depicts tumor volume over time (post-huPBMC engraftment) in pp65-MCF7 and huPBMC-engrafted NSG mice dosed with XENP16432 or XmAb23104.

FIG. 117 depicts the sequences of XENP20053, a bottle opener format with the aCTLA-4 as the Fab side (|[αCTLA-4]_H3L0.22) and the PD-1 as the scFv (1G6_L1.94_H1.279). The CDRs are underlined, the scFv linker is double underlined (in the sequences, the scFv linker is a positively charged scFv (GKPGS)4 linker (SEQ ID NO: 26209), although as will be appreciated by those in the art, this linker can be replaced by other linkers, including uncharged or negatively charged linkers, some of which are depicted in FIG. 8), and the slashes indicate the border(s) of the variable domains. As noted herein and is true for every sequence herein containing CDRs, the exact identification of the CRD locations may be slightly different depending on the numbering used as is shown in Table 1, and thus included herein are not only the CDRs that are underlined but also CDRs included within the VH and VL domains using other numbering systems.

Figure 118:
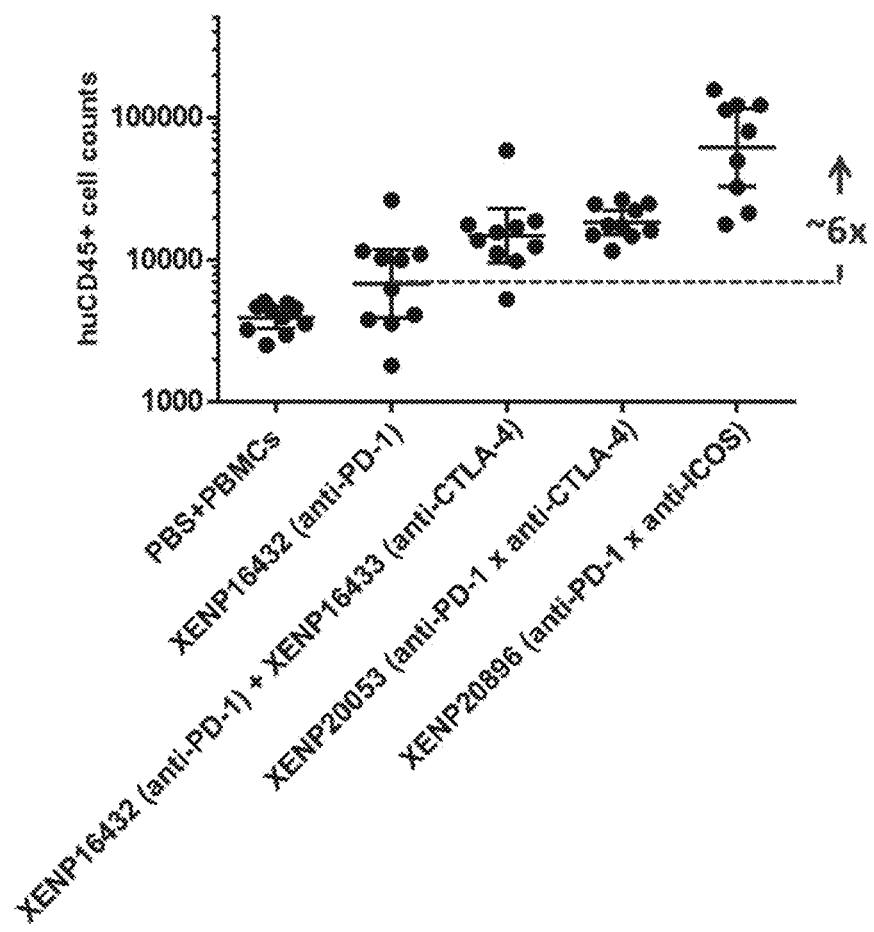
Figure 119A:
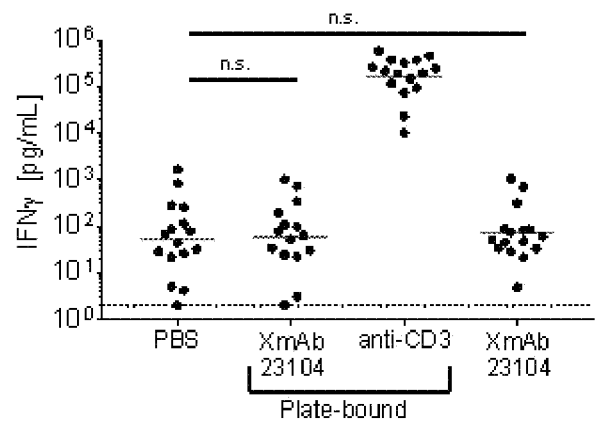
Figure 119B:
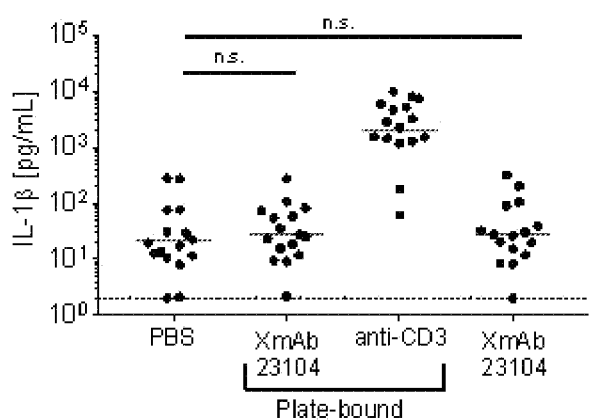
Figure 119C:
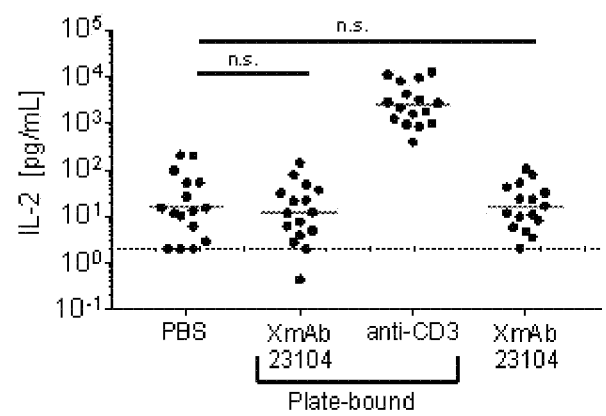
Figure 119D:
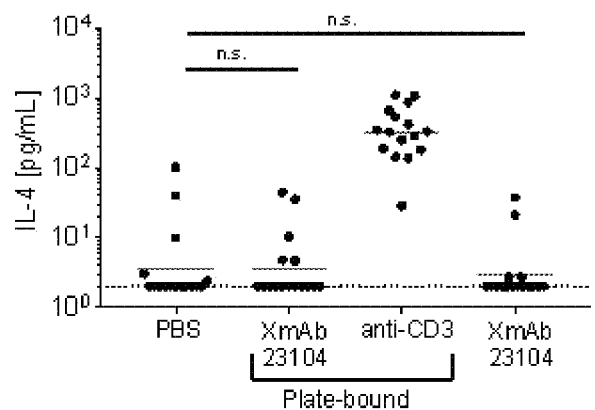
Figure 119E:
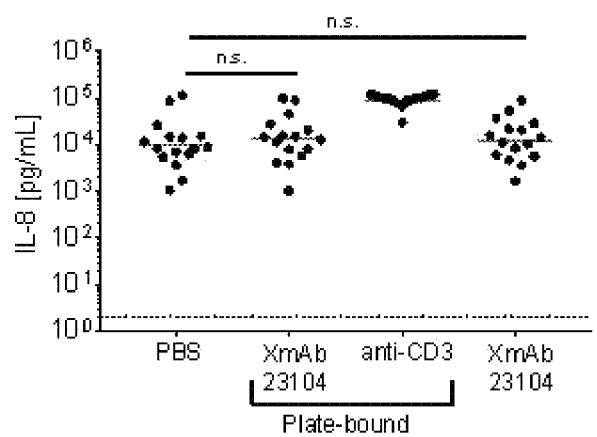
Figure 119F:
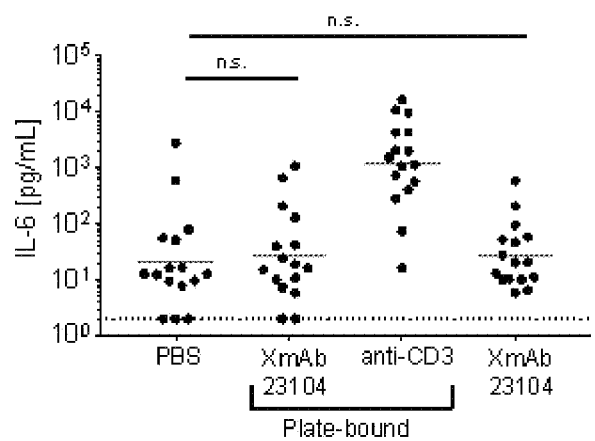
Figure 119G:
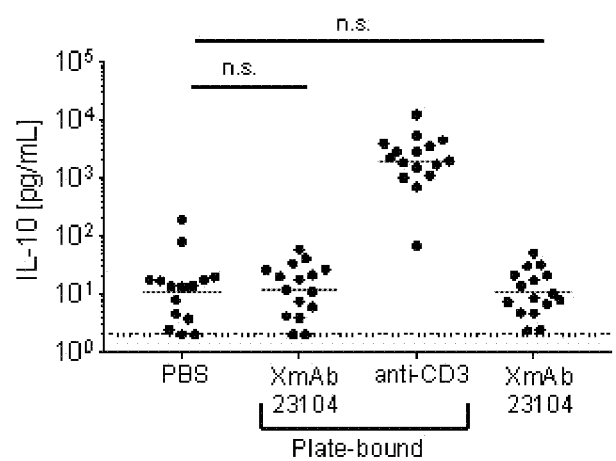
Figure 119H:
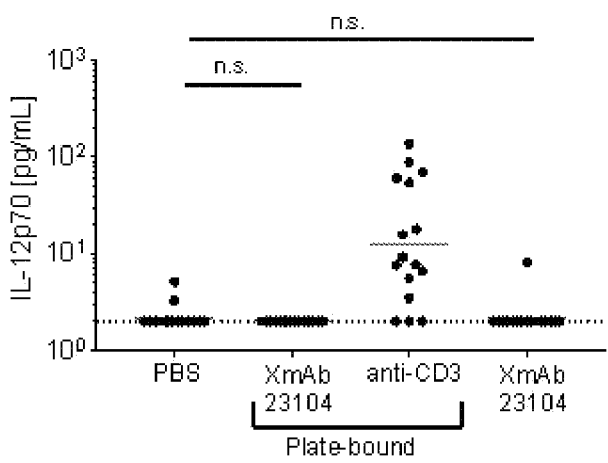
Figure 119I:
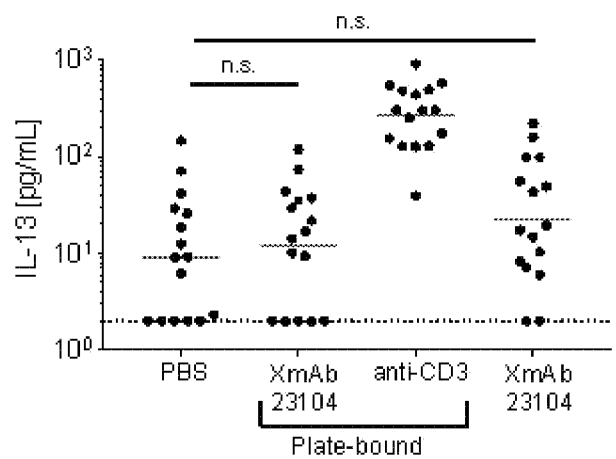
Figure 119J:
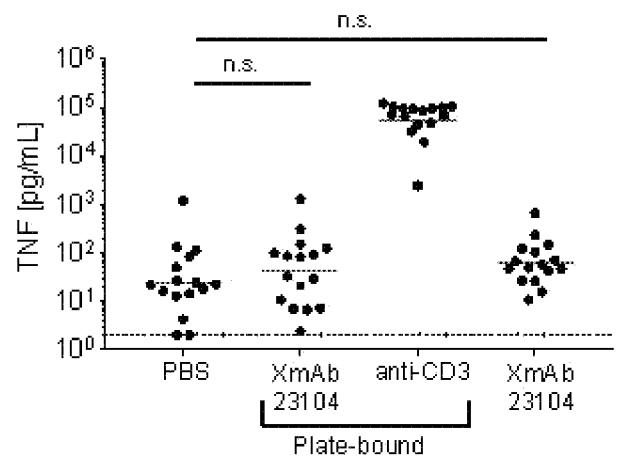
Figure 121A:
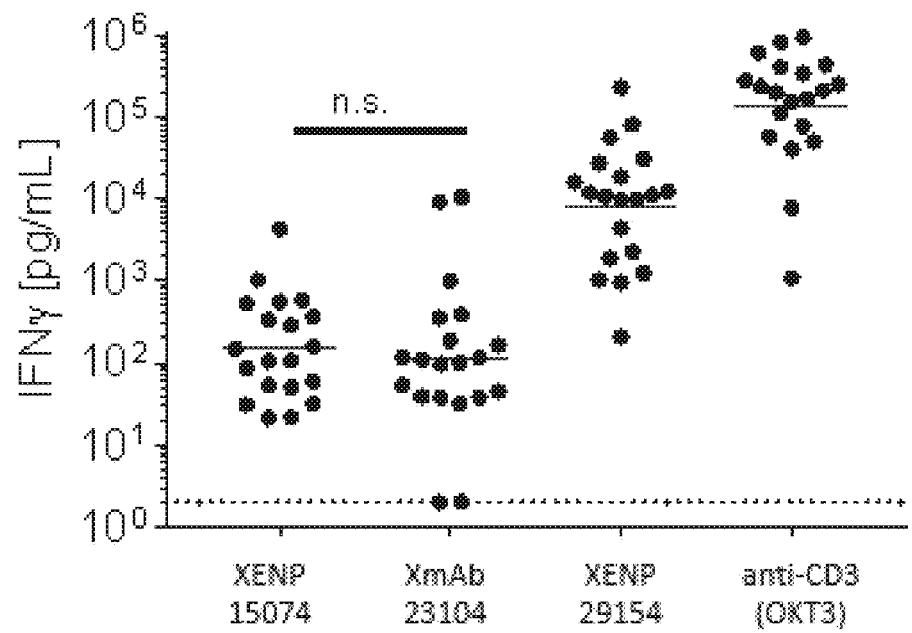
Figure 121B:
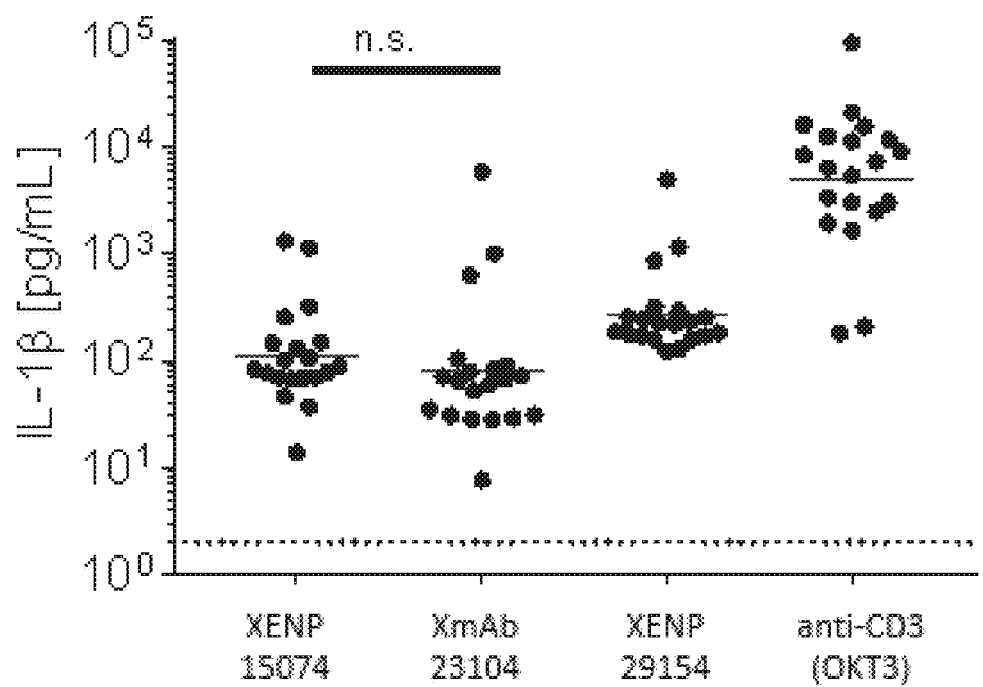
Figure 121C:
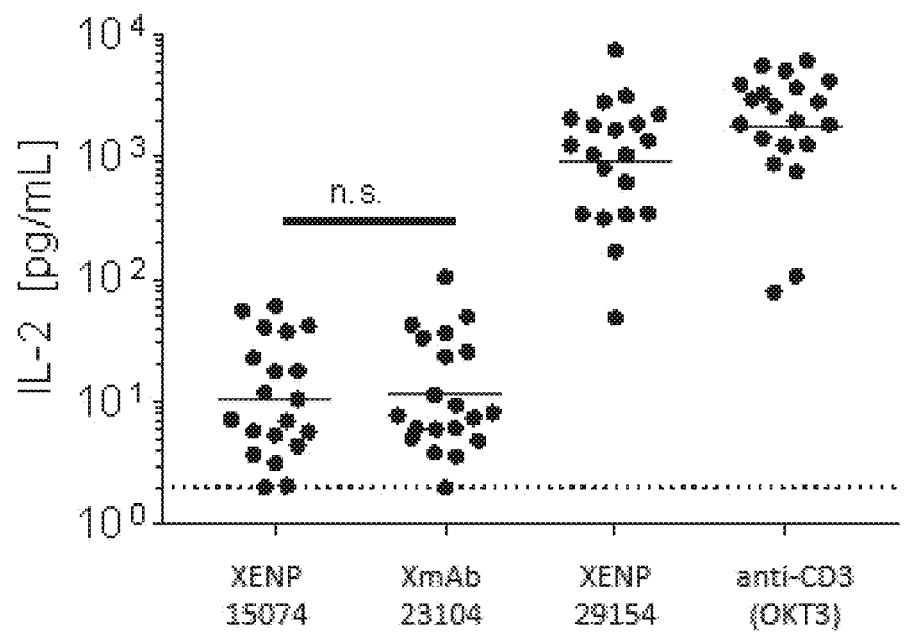
Figure 121D:
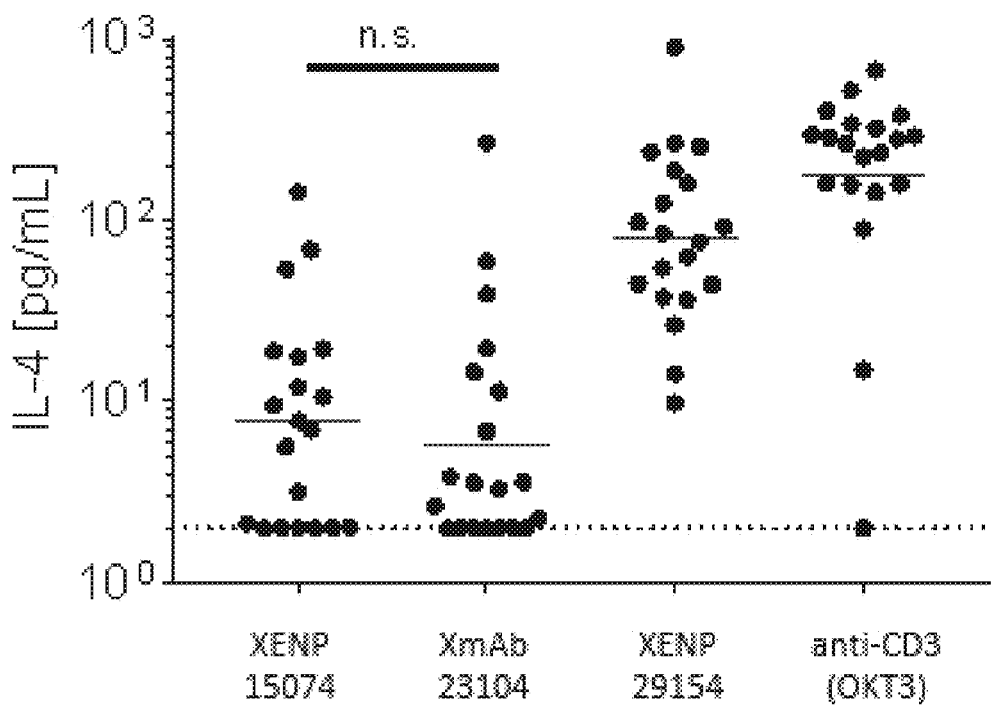
Figure 121E:
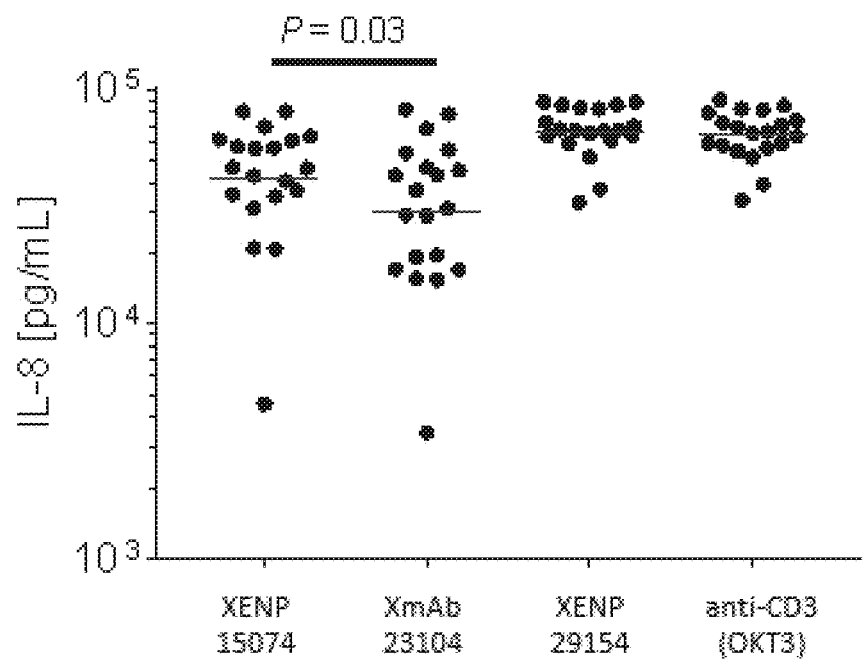
Figure 121F:
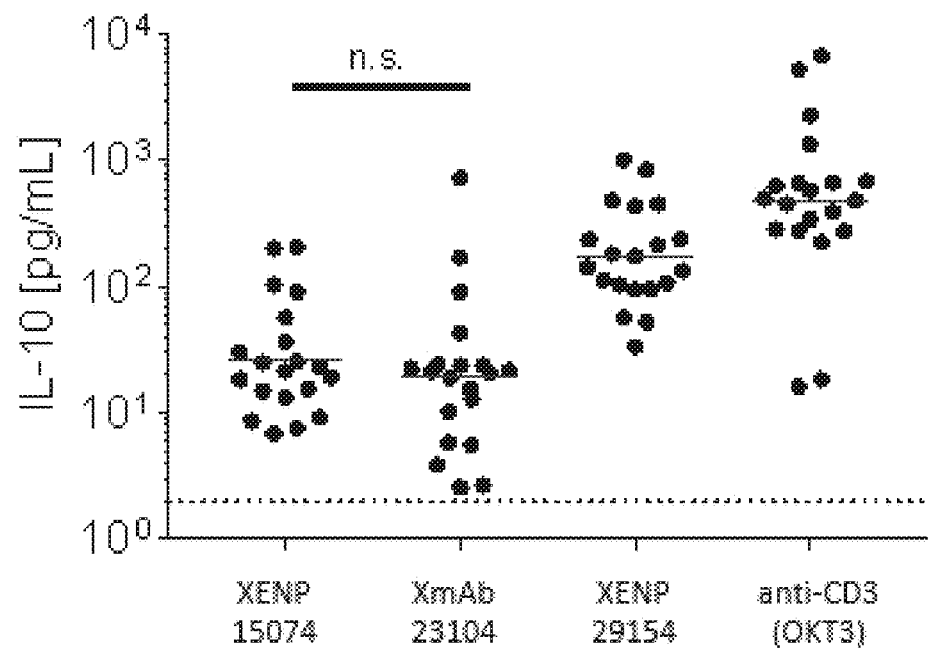
Figure 121G:
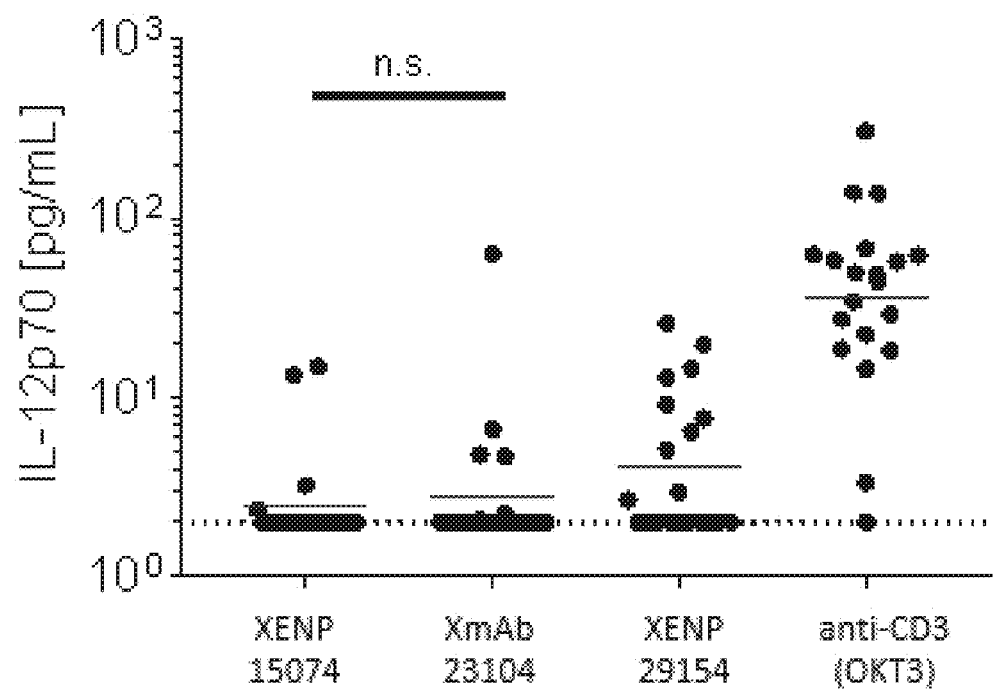
Figure 121H:
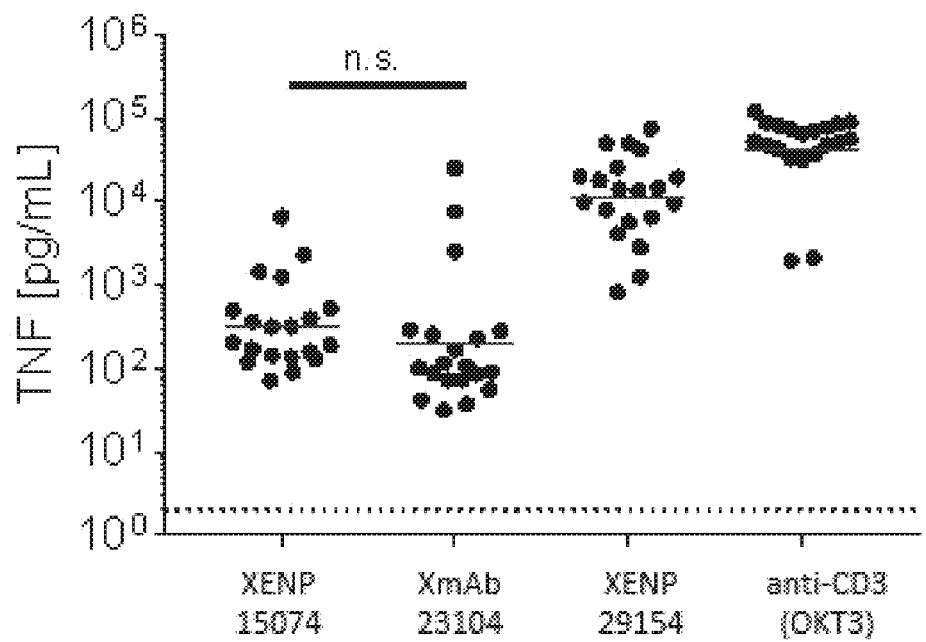
Figure 121I:
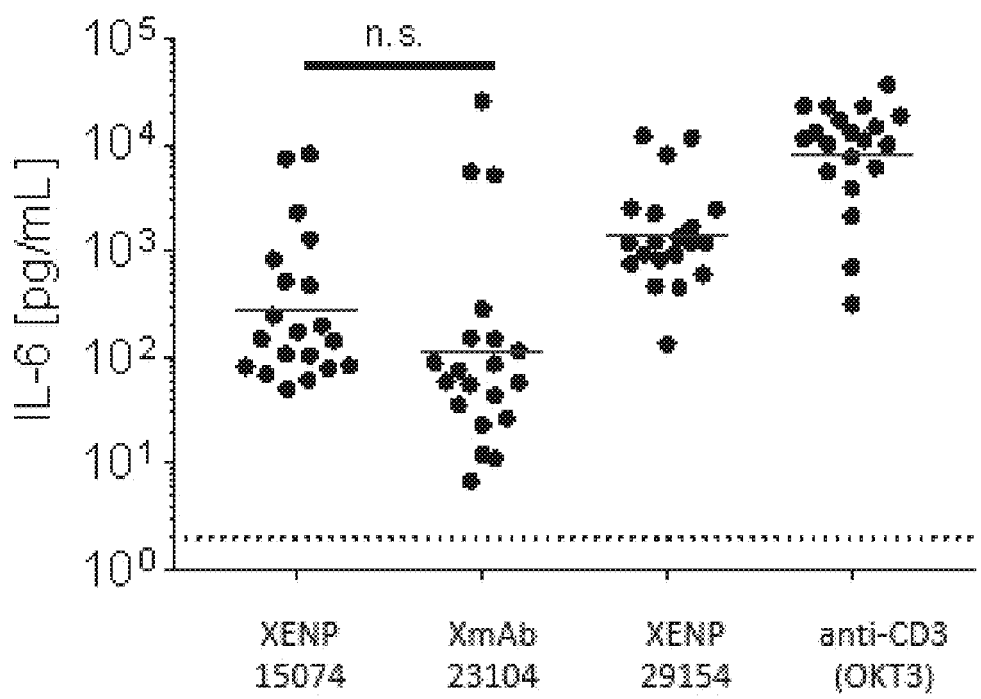
Figure 121J:
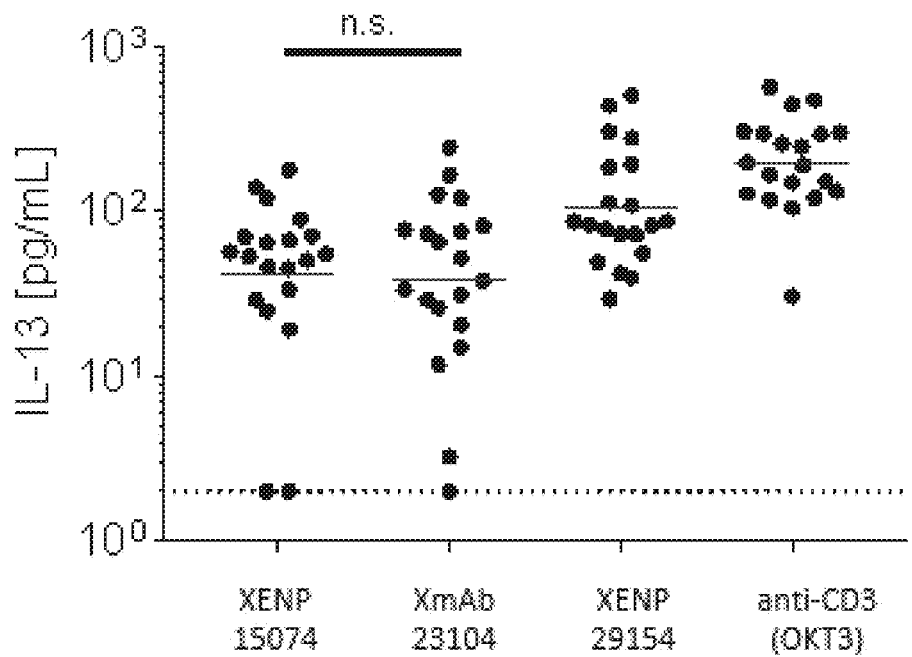

FIG. 118 depicts CD45+ cell counts in NSG mice on Day 14 after engraftment with human PBMCs and treatment with the indicated test articles.

FIG. 119A to 119J depicts the release of A) IFNγ, B) IL-1B, C) IL-2, D) IL-4, E) IL-8, F) IL-6, G) IL-10, H) IL-12p70, I) IL-13, and J) TNFα from human PBMCs treated with PBS, plate-bound XmAb23104, soluble XmAb23104, and plate-bound anti-CD3 antibody (OKT3).

FIG. 120 depicts the sequences for XENP29154, which is in-house produced TGN1412.

FIG. 121A to 121J depicts the release of A) IFNγ, B) IL-1B, C) IL-2, D) IL-4, E) IL-8, F) IL-10, G) IL-12p70, H) TNF, I) IL-6, and J) IL-13 from human PBMCs treated with air-dried XmAb23104, air-dried XENP15074 (isotype control), air-dried XENP29154 (positive control), and air-dried anti-CD3 mAb (OKT3; positive control).

Figure 122A:
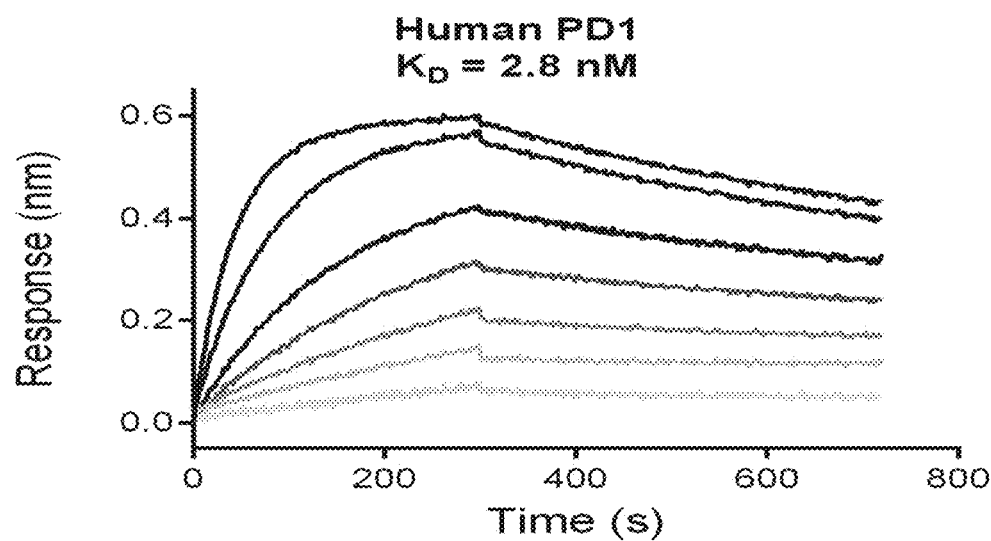
Figure 122B:
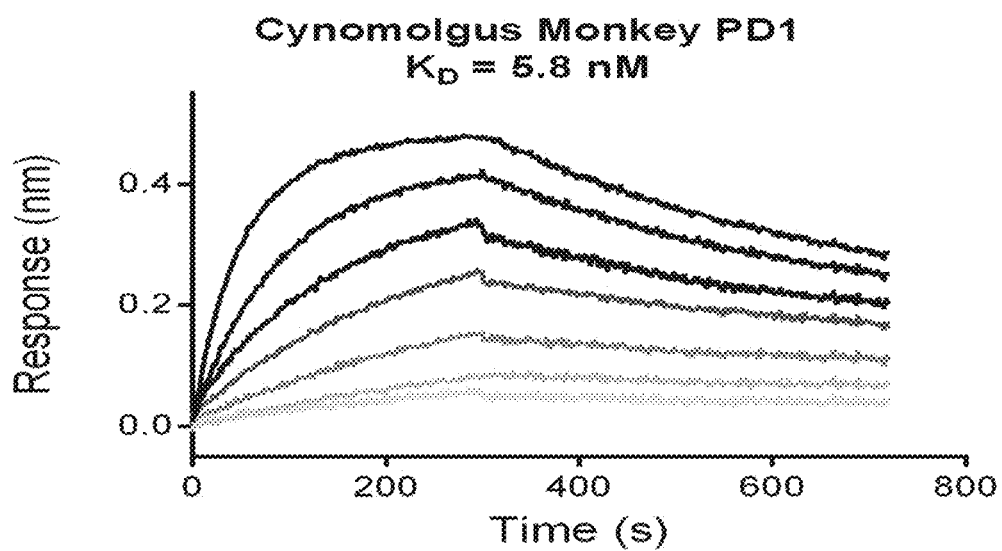

FIGS. 122A and 122B depicts sensorgrams showing binding of XmAb23104 to A) human PD-1 and B) cynomolgus PD-1.

Figure 123A:
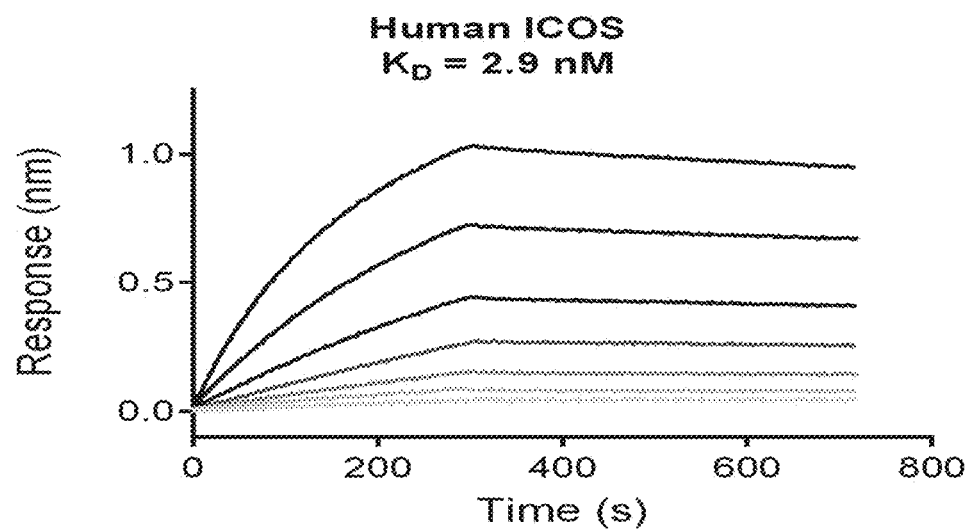
Figure 123B:
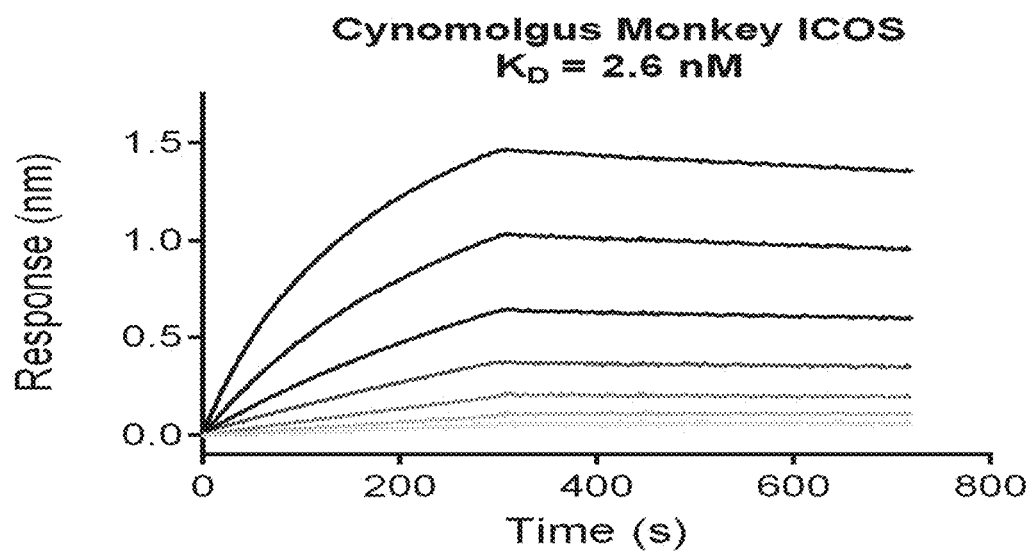

FIGS. 123A and 123B depict sensorgrams showing binding of XmAb23104 to A) human ICOS and B) cynomolgus ICOS.

FIG. 124 depicts the equilibrium dissociation constants (KD), association rates (ka), and dissociation rates (kd) for binding of XmAb23104 to human and cynomolgus PD-1 and ICOS.

Figure 125:
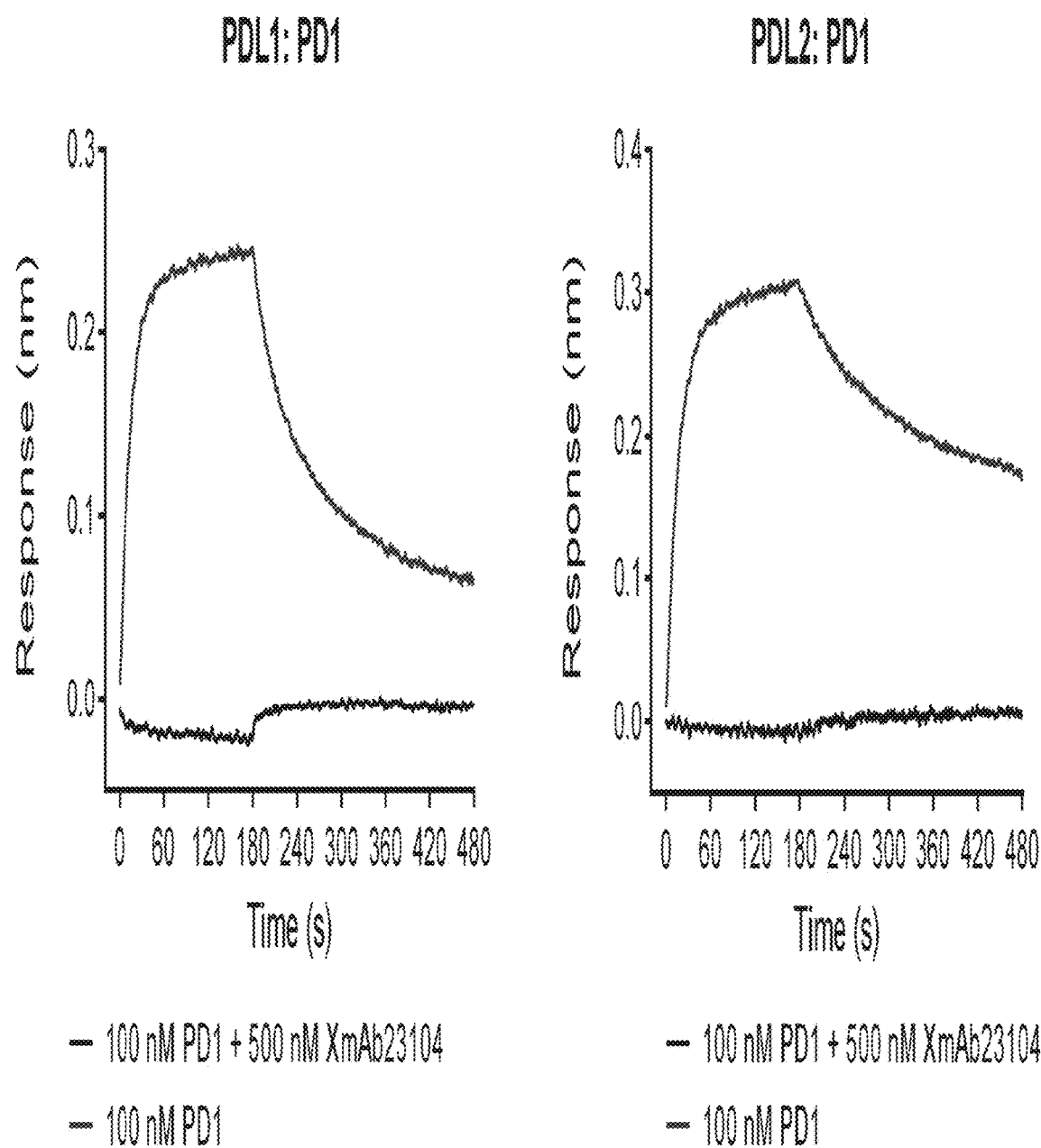

FIG. 125 depicts sensorgrams from competition binding experiments of PD-1 and ligands PD-L1 and PD-L2 with and without XmAb23104 pre-incubation.

Figure 126A:
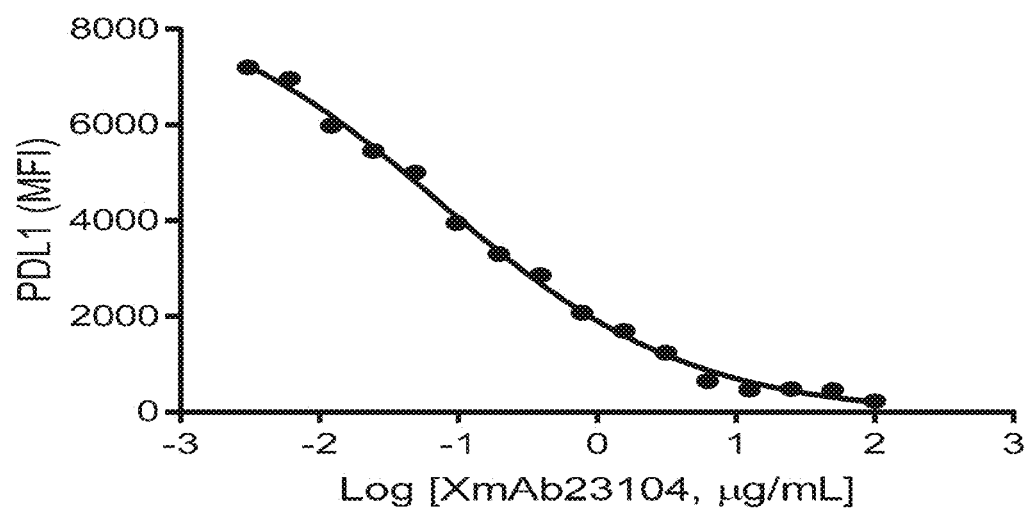
Figure 126B:
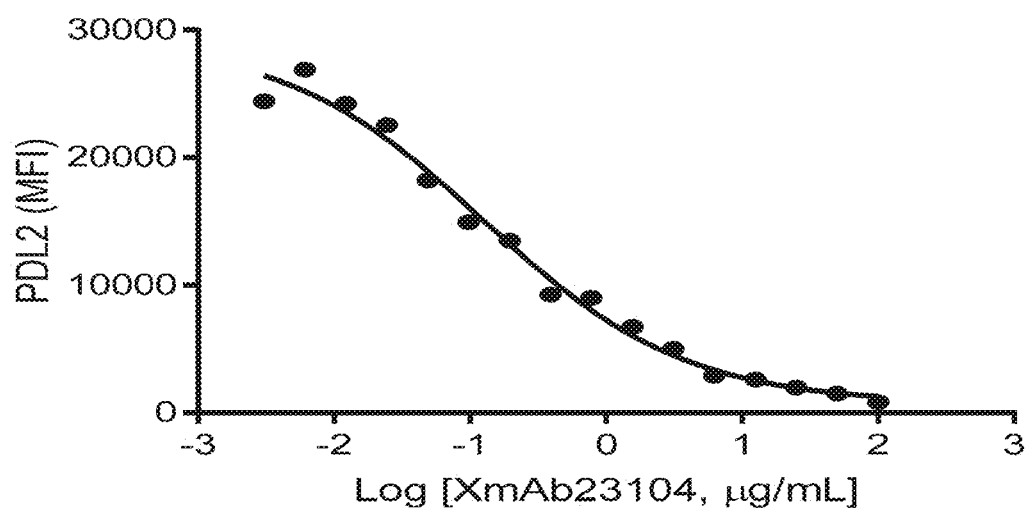
Figure 126C:
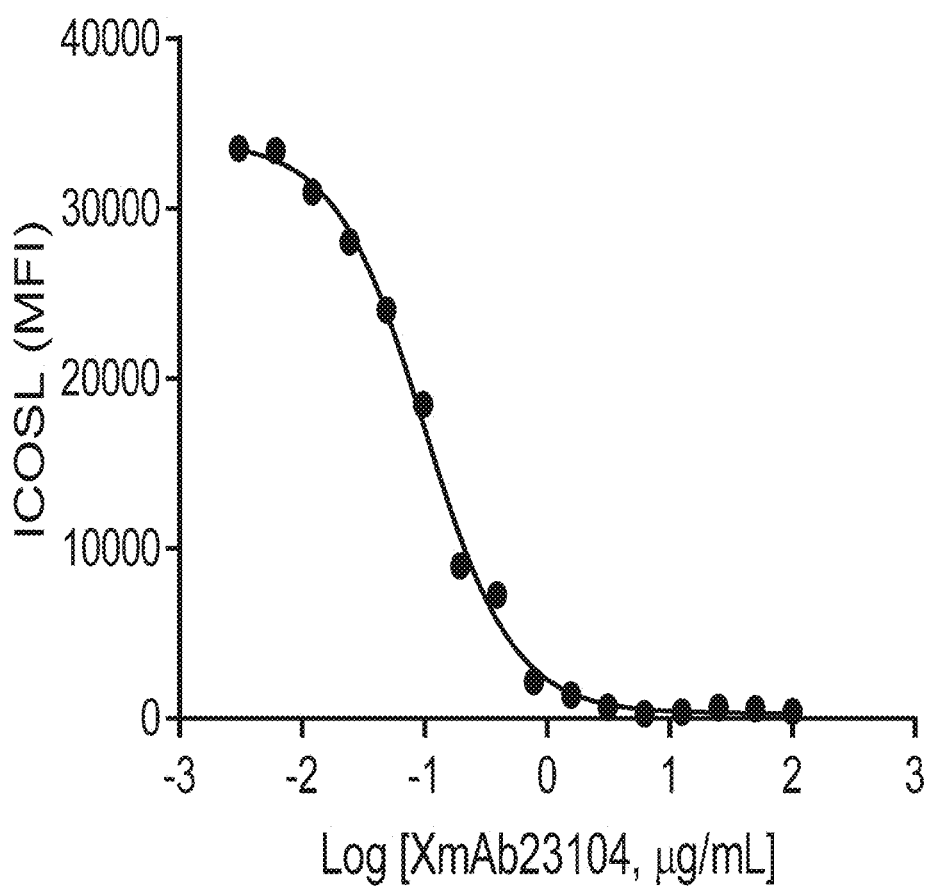

FIG. 126A to 126C depicts blocking of A) soluble PD-L1, B) soluble PD-L2, and C) soluble ICOSL to cell surface-expressed PD-1 and ICOS on PD-1+ICOS+ HEK 293T cells.

Figure 127:
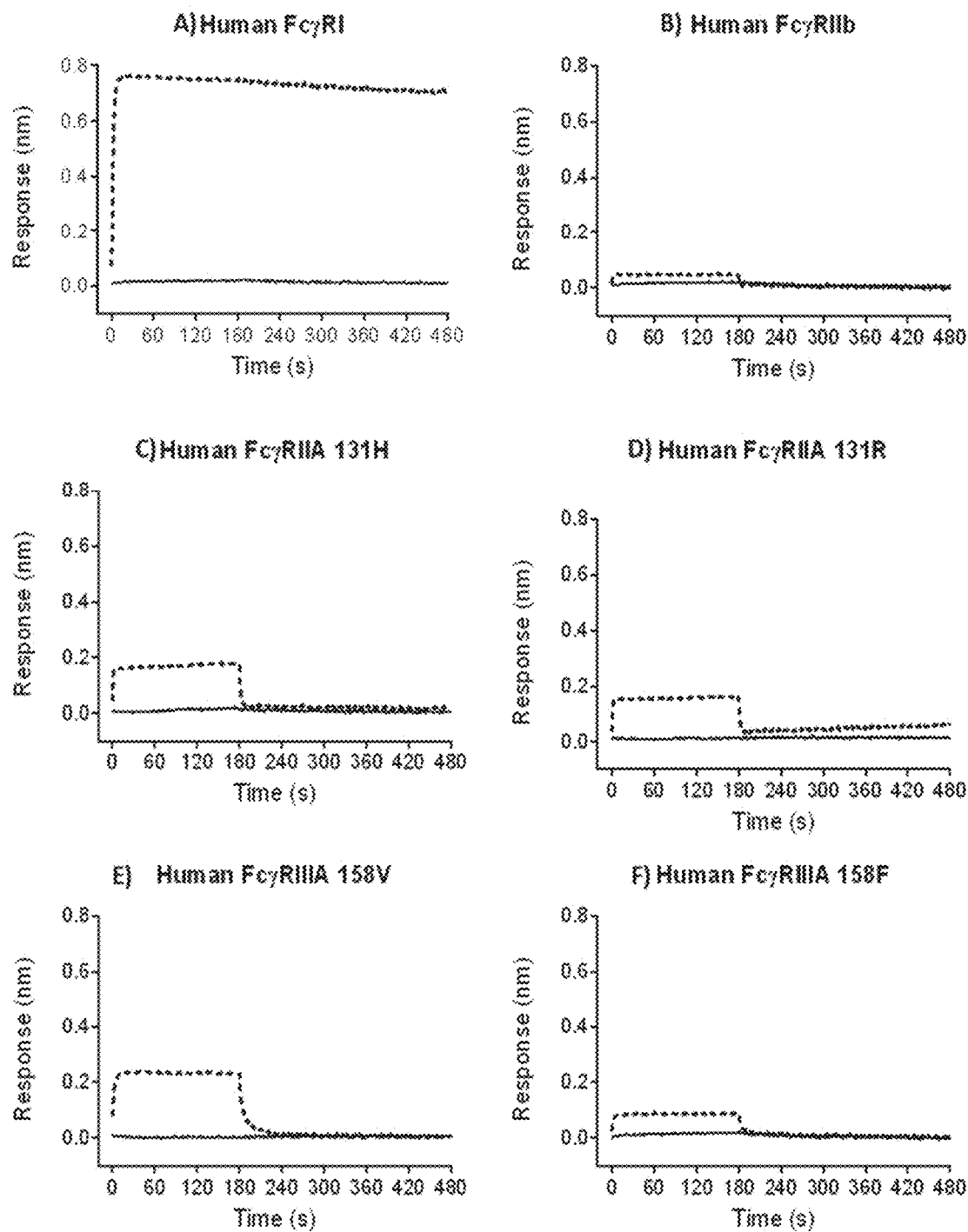

FIG. 127 depicts sensorgrams showing binding of XmAb23104 (solid line) and human IgG comparator (an anti-CD19 antibody with a native IgG1 constant region; dotted line) to A) human FcγRI, B) human FcγRIIb, C) human FcγRIIA (131H), D) human FcγRIIA (131R), E) human FcγRIIIA (158V), and F) human FcγRIIIA (158F).

Figure 128:
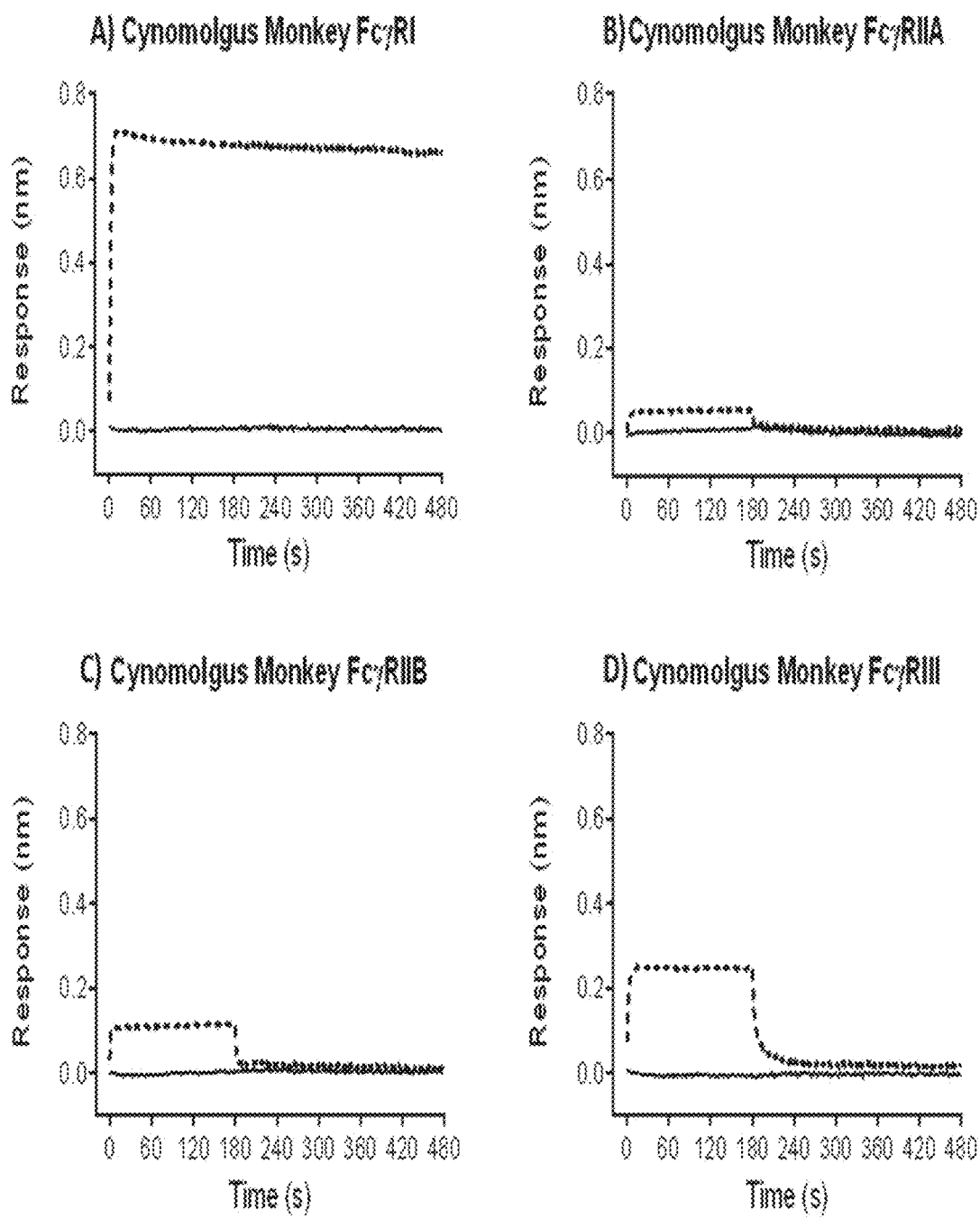

FIG. 128 depicts sensorgrams showing binding of XmAb23104 (solid line) and human IgG comparator (an anti-CD19 antibody with a native IgG1 constant region; dotted line) to A) cynomolgus FcγRI, B) cynomolgus FcγRIIA, C) cynomolgus FcγRIIb, and D) cynomolgus RcγRIIIA.

Figure 129:
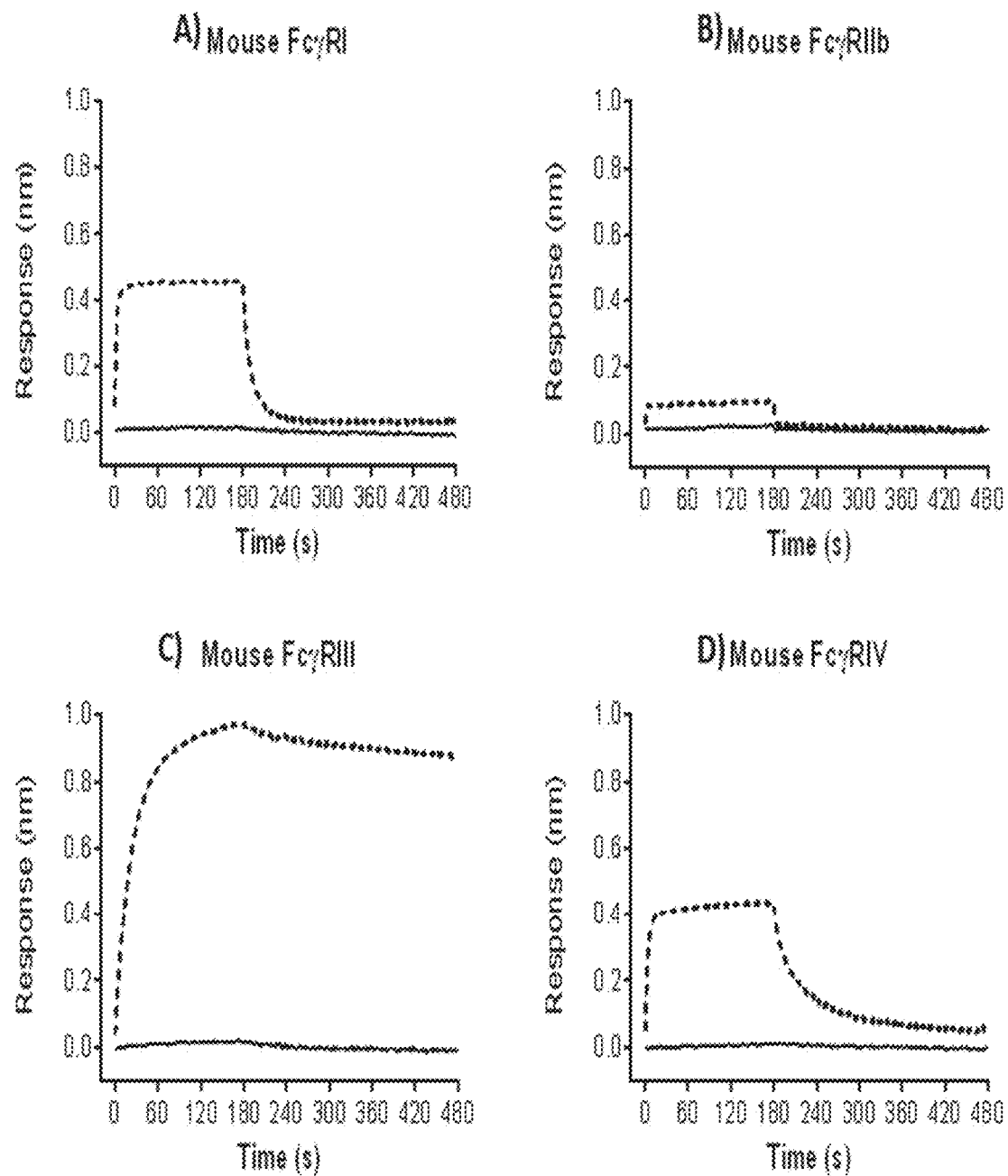

FIG. 129 depicts sensorgrams showing binding of XmAb23104 (solid line) and human IgG comparator (an anti-CD19 antibody with a native IgG1 constant region; dotted line) to A) murine FcγRI, B) murine FcγRIIb, C) murine FcγRIII, and D) murine FcγRIV.

Figures 130, 131:
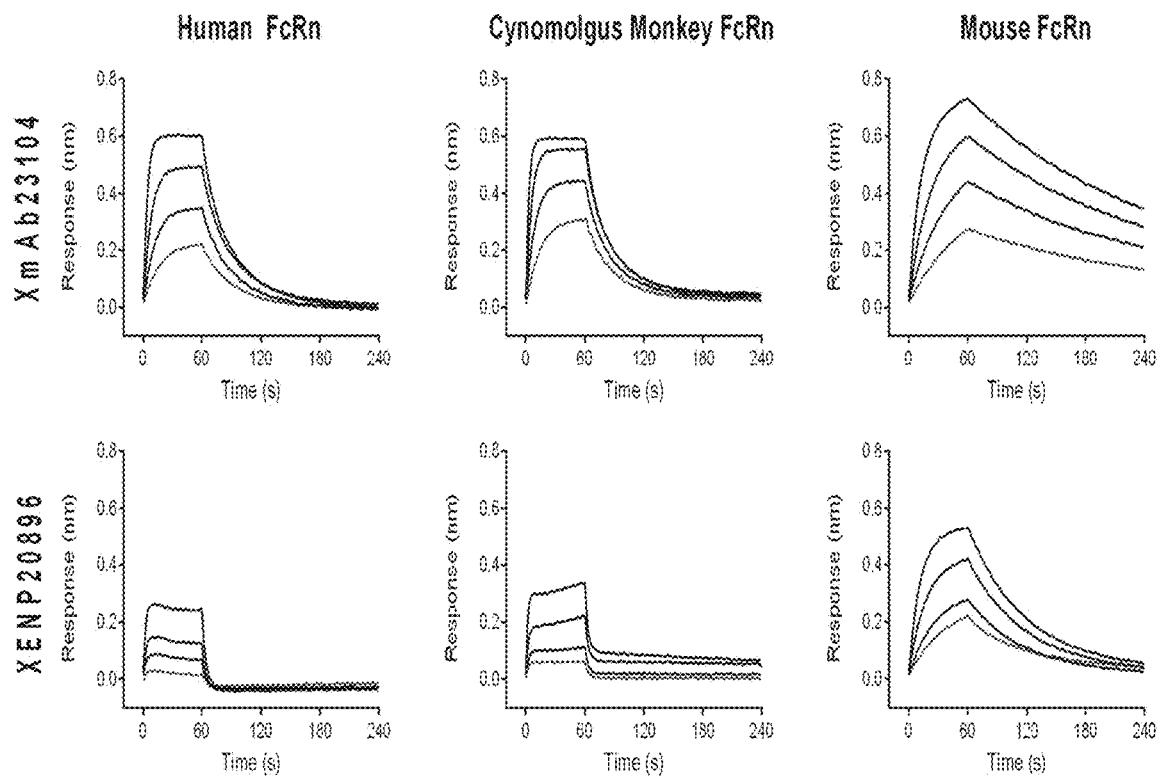

FIG. 130 depicts equilibrium dissociation constants ($K_D$) for binding of XmAb23104 and XENP20896 to human, cynomolgus, and mouse FcRn at pH 6.0.

FIG. 131 depicts sensorgrams showing binding of XmAb23104 and XENP20896 to human, cynomolgus, and mouse FcRn (1000, 500, 250, and 125 nM) at pH 6.0.

Figure 132:
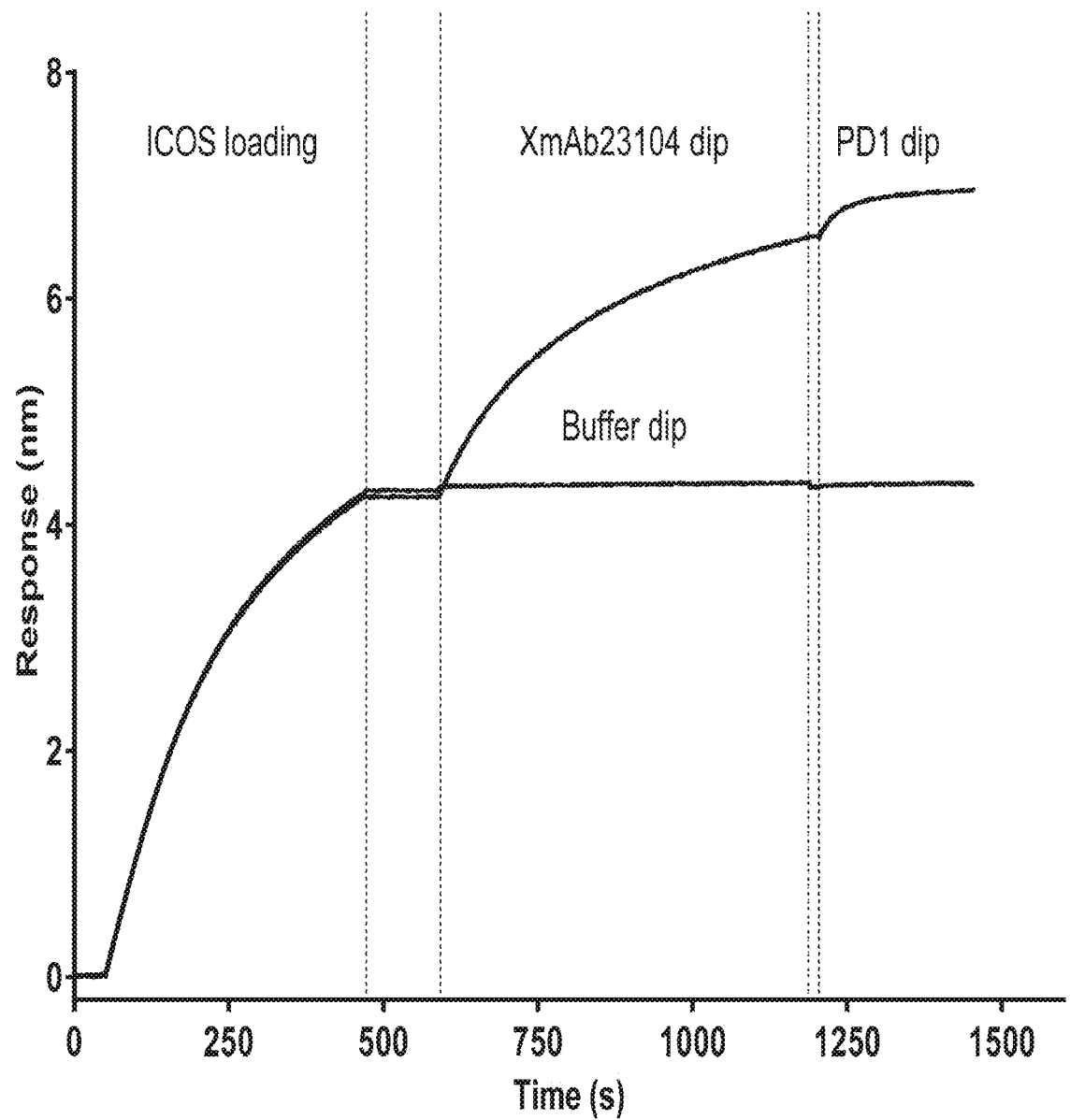

FIG. 132 depicts in-tandem BLI experiment showing biosensors loaded with ICOS and dipped into XmAb23104 or buffer followed by a final dip into PD-1 antigen.

Figure 133:
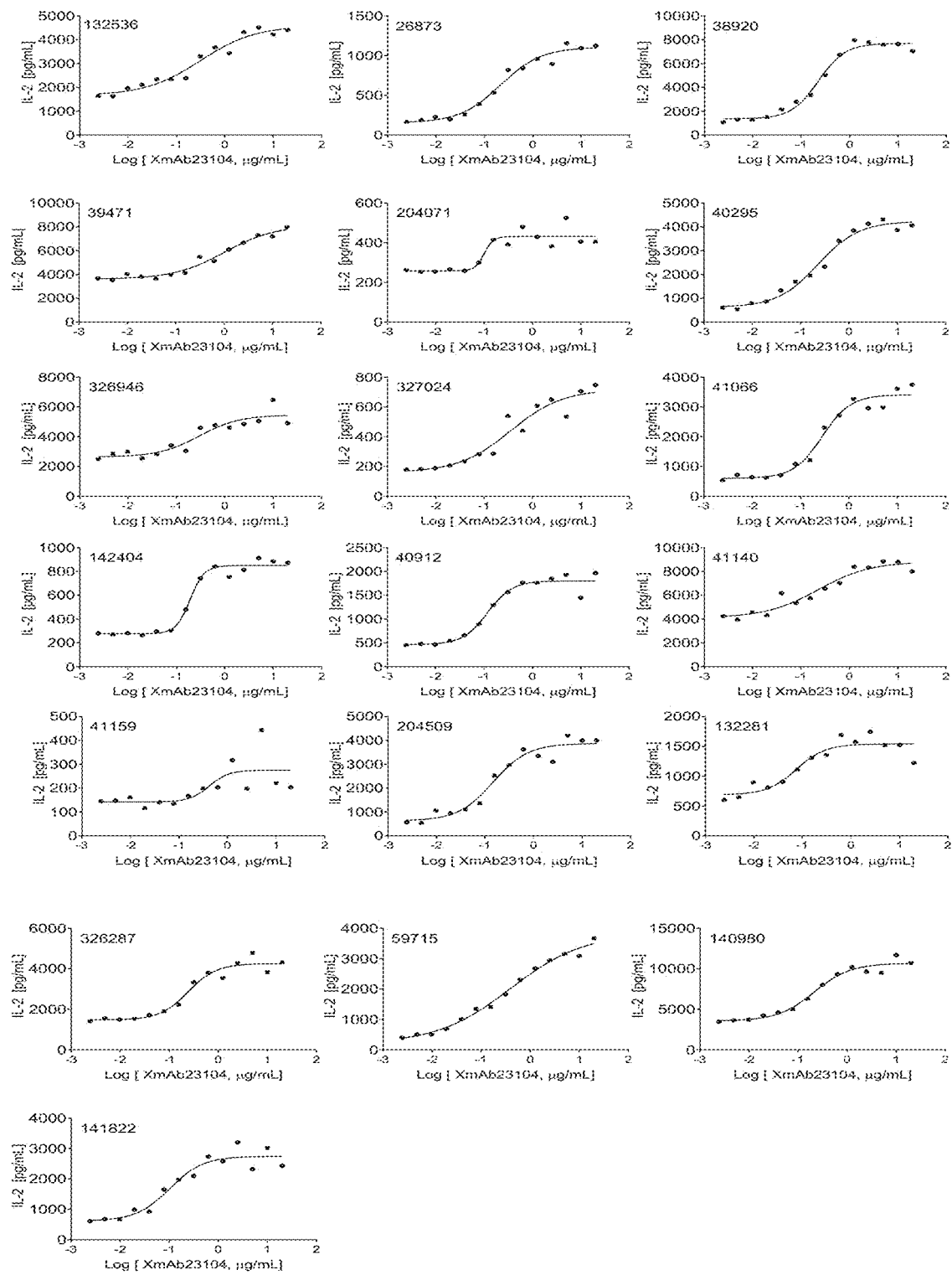

FIG. 133 depicts dose-dependent promotion of IL-2 secretion from SEB-stimulated human PBMCs (from 19 different donors) by XmAb23104.

Figure 134:
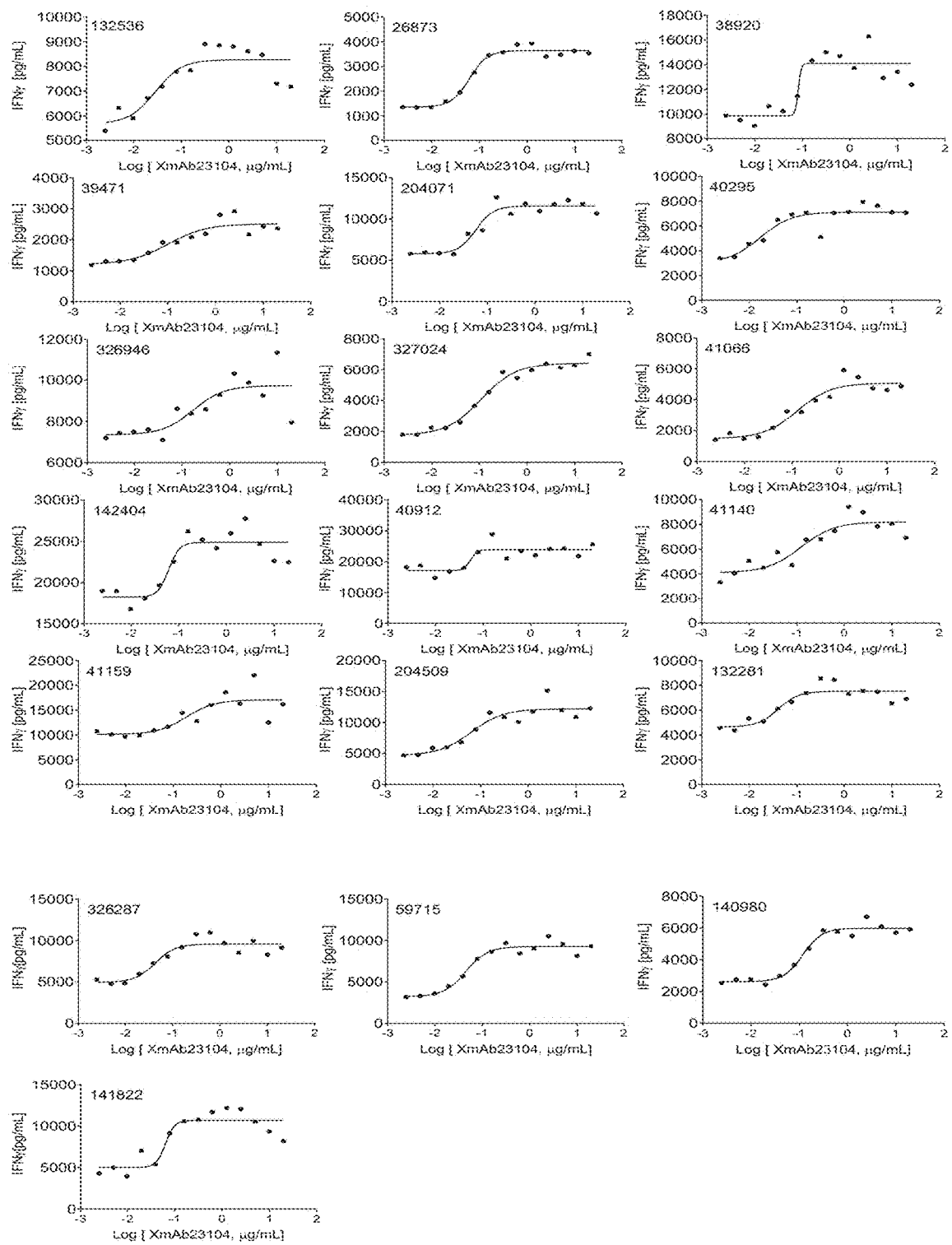

FIG. 134 depicts dose-dependent promotion of IFNγ secretion from SEB-stimulated human PBMCs (from 19 different donors) by XmAb23104.

Figure 135:
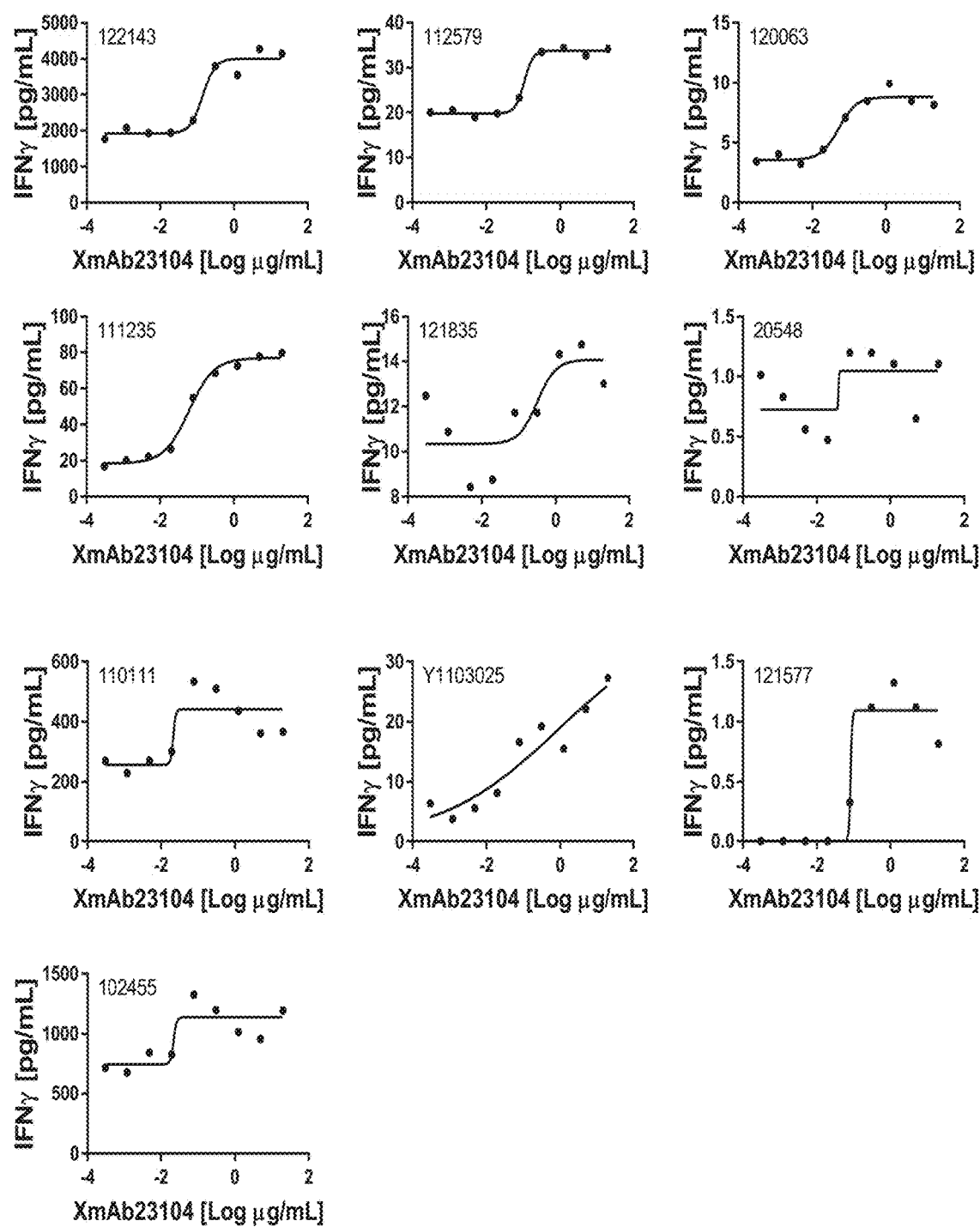

FIG. 135 depicts dose-dependent promotion of IFNγ secretion from SEB-stimulated cynomolgus PBMCs (from 10 different donors) by XmAb23104.

Figure 136:
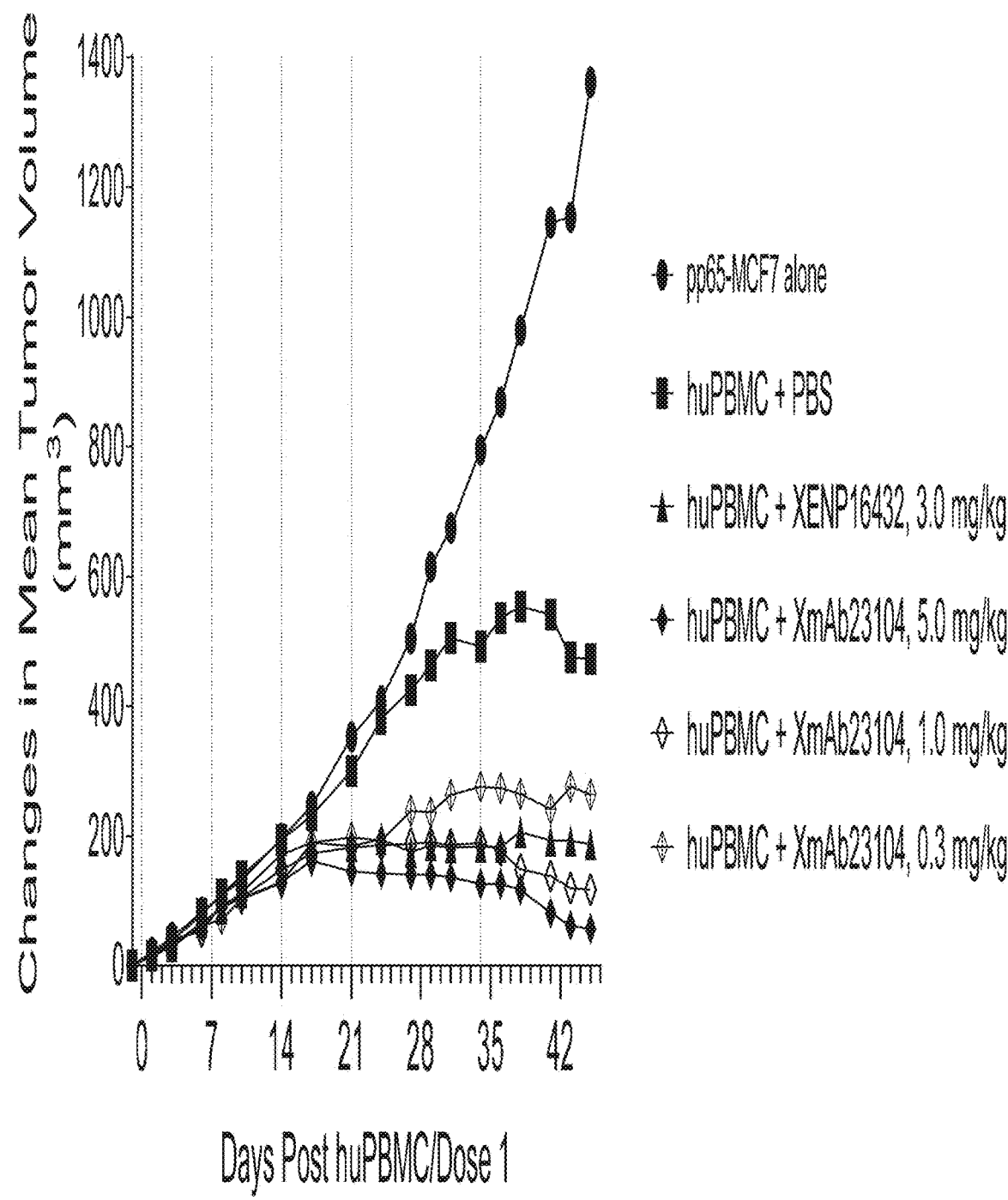

FIG. 136 depicts tumor volume over time (post-huPBMC engraftment) in pp65-MCF7 and huPBMC-engrafted NSG mice dosed with XENP16432 or indicated concentrations of XmAb23104.

Figure 137A:
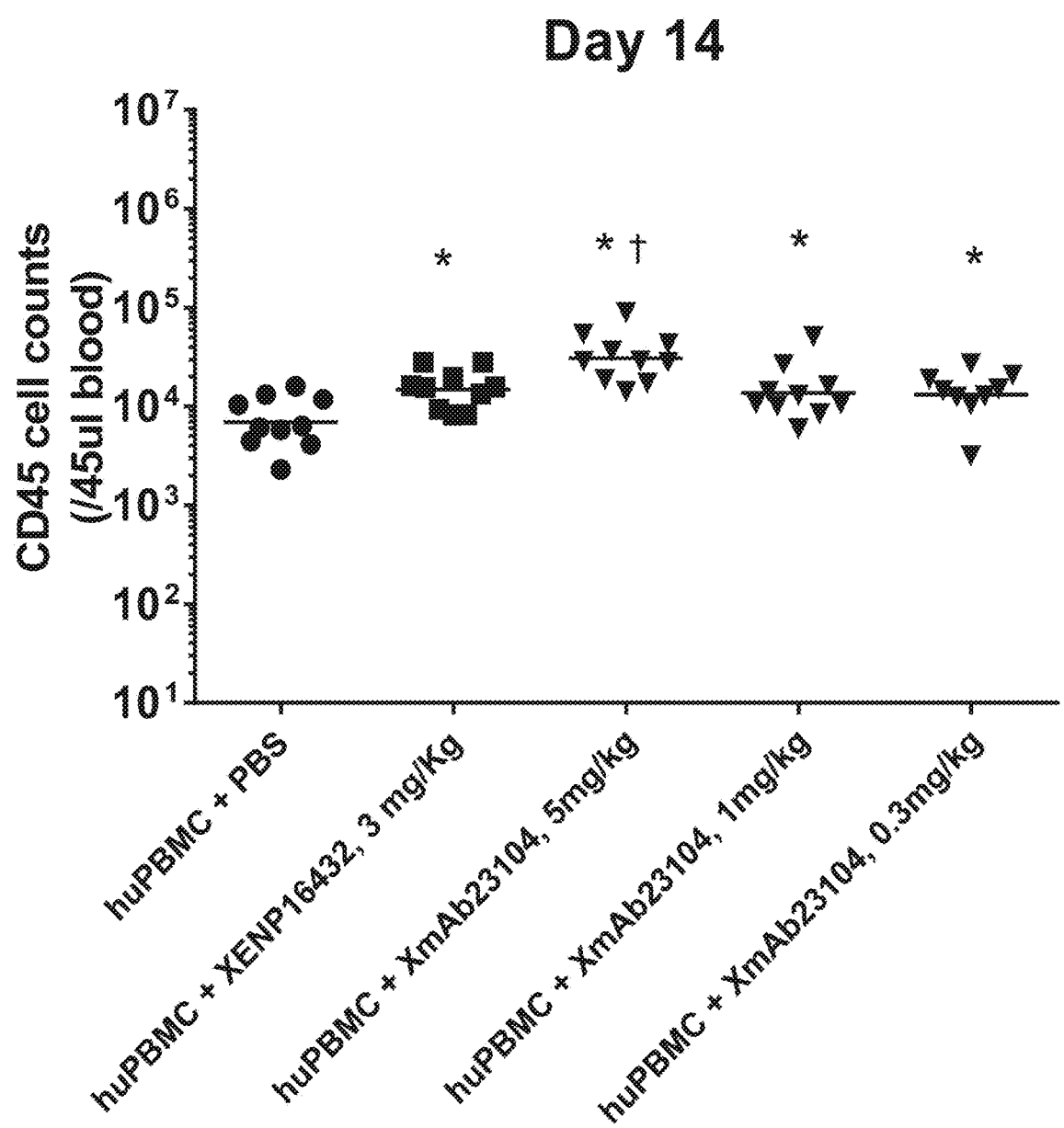
Figure 137B:
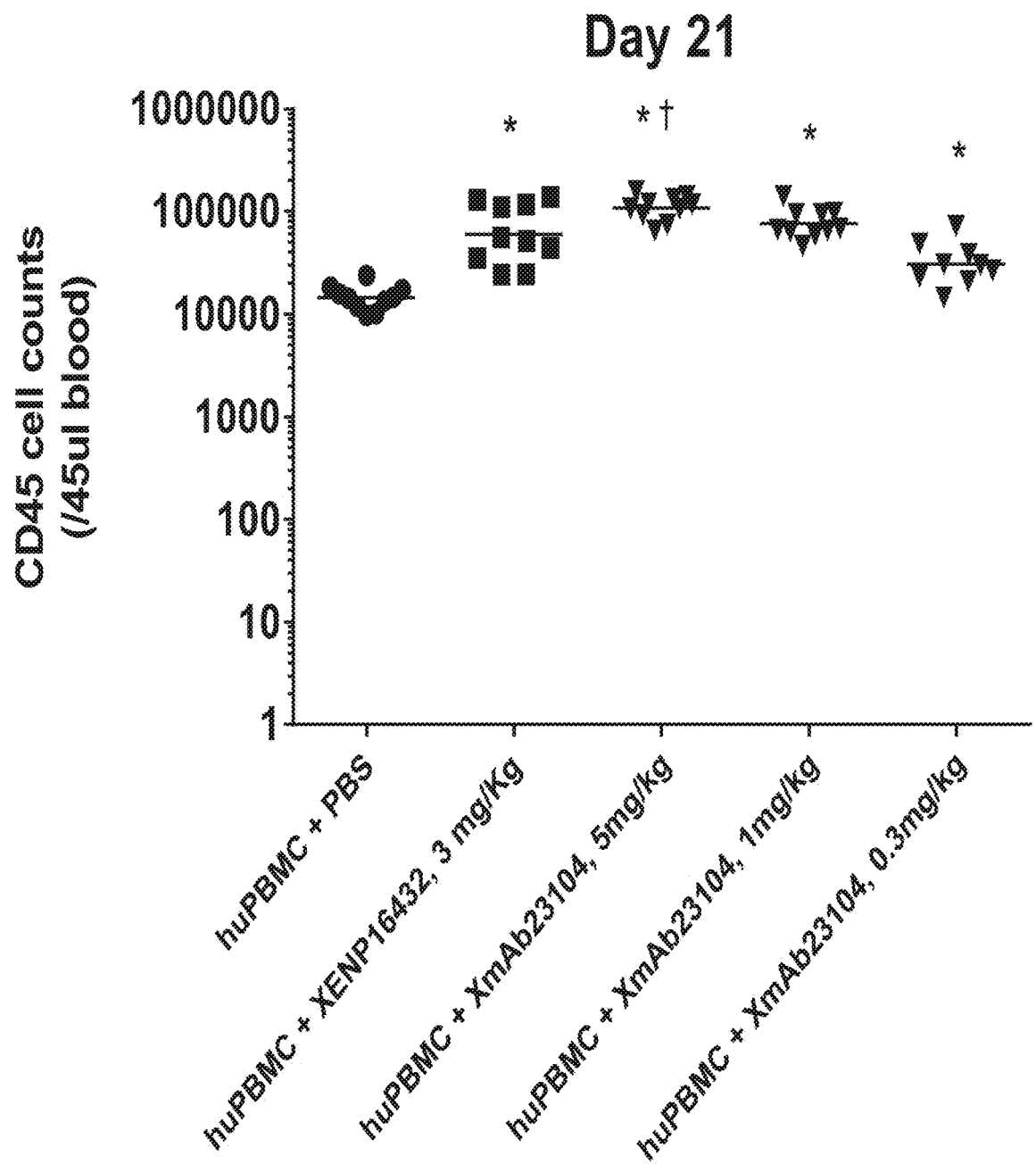
Figure 140A:
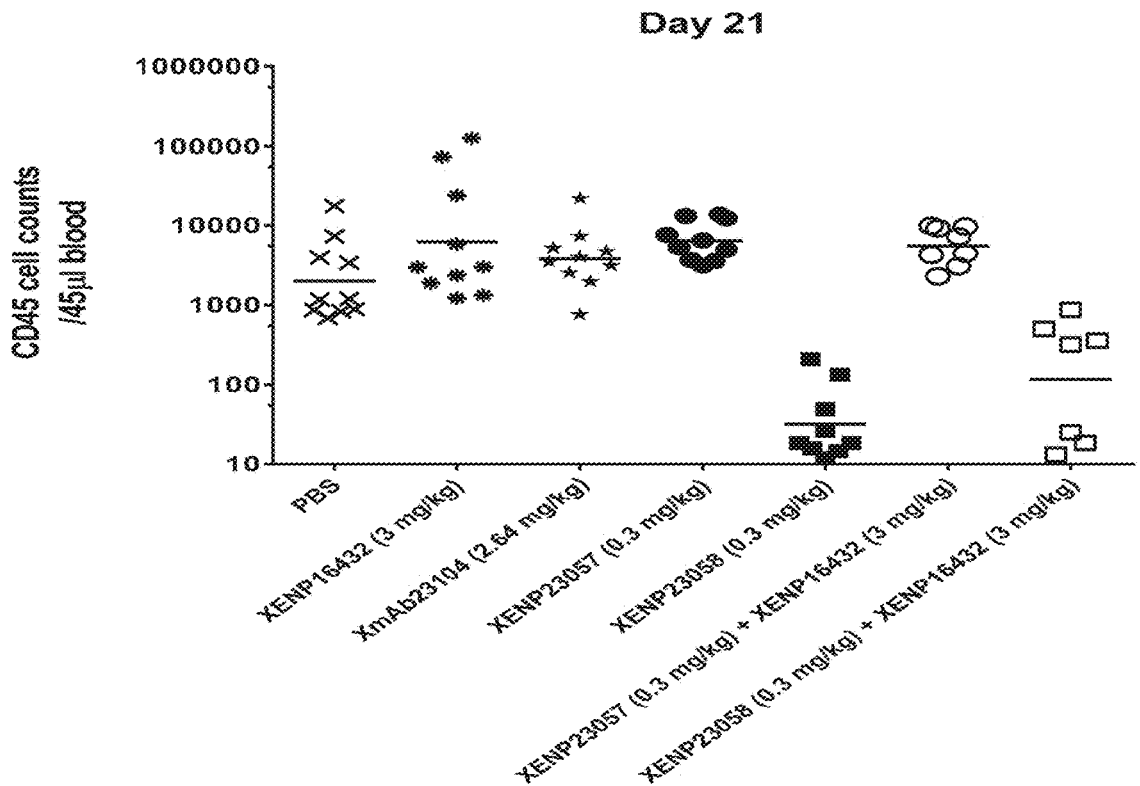
Figure 140B:
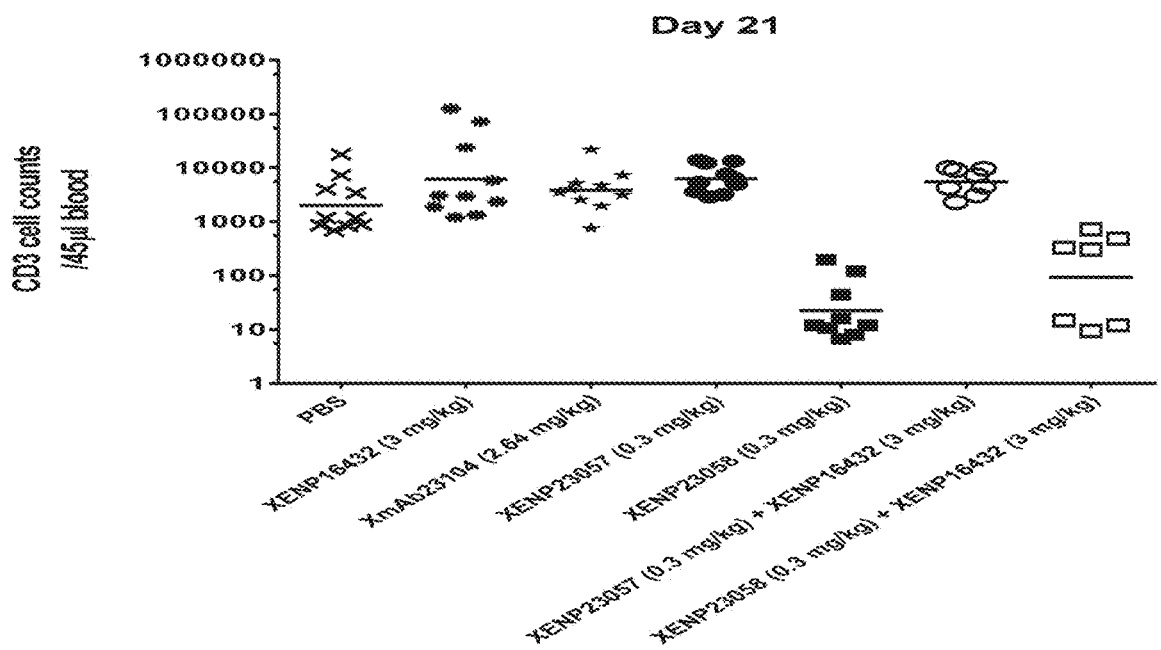
Figure 140C:
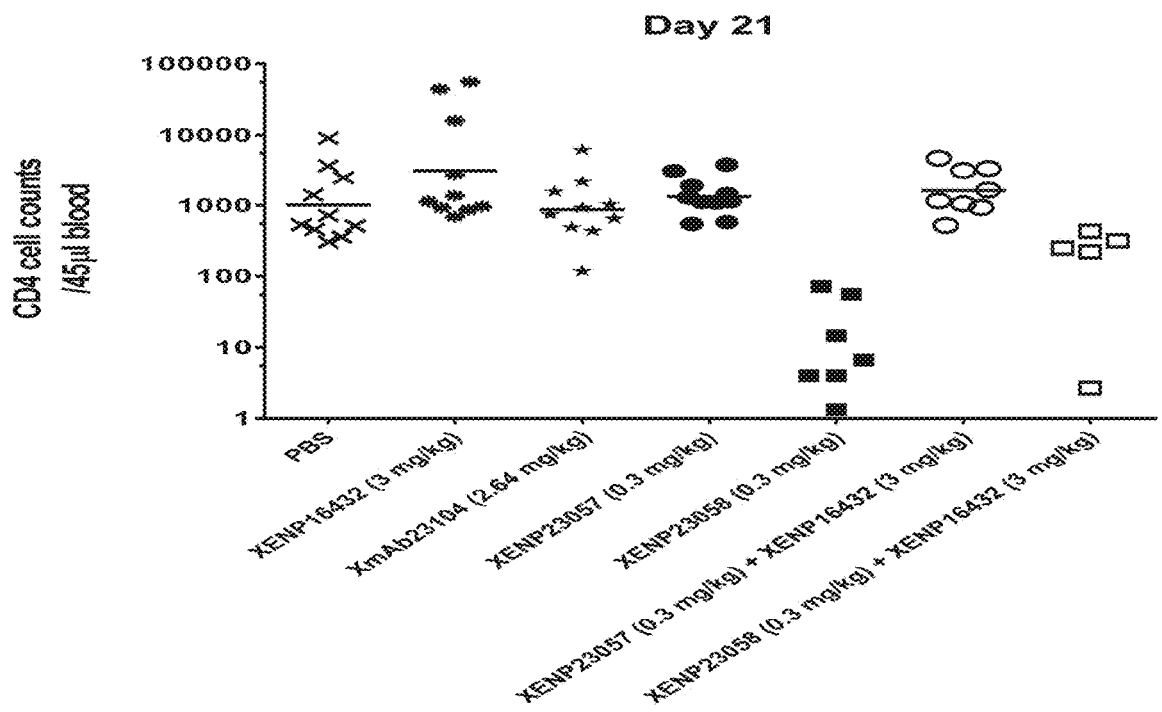
Figure 140D:
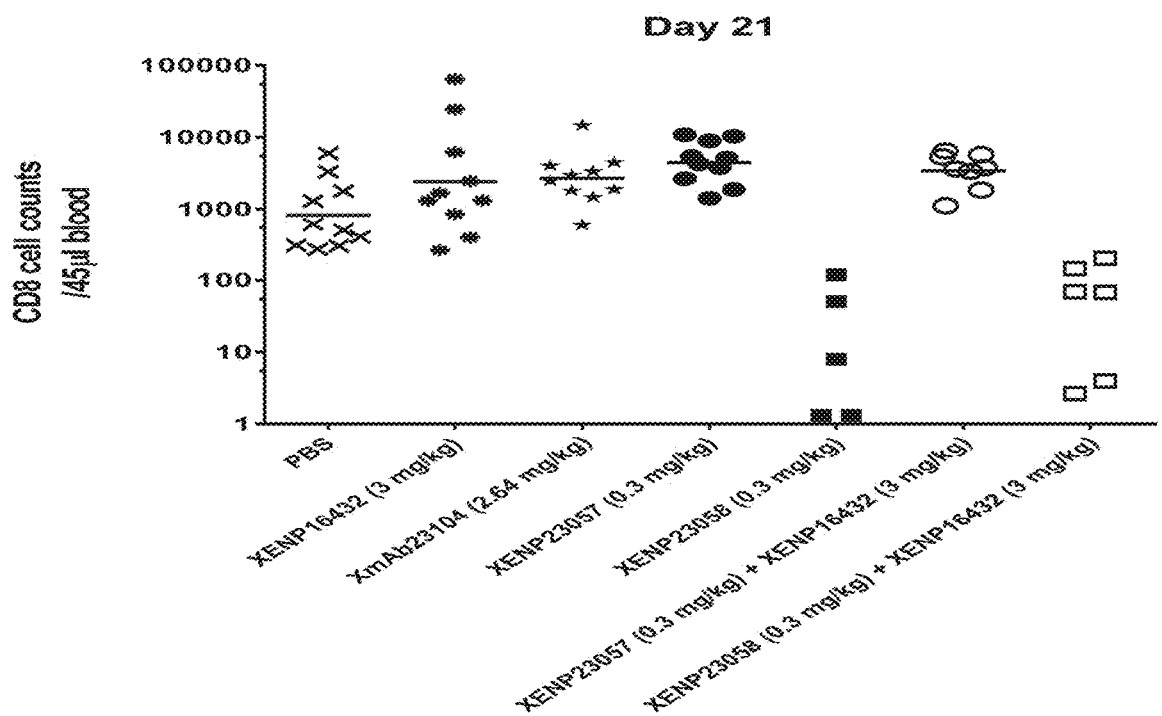

FIGS. 137A and 137B depict human CD45 cell counts on A) Day 14 and B) Day 21 in pp65-MCF7 and huPBMC-engrafted NSG mice dosed with XENP16432 or indicated concentrations of XmAb23104. *denotes P<0.05, unpaired Student t test, XmAb23104 or anti-PD-1 XENP16432-treated groups compared to PBS-treated group. † denotes P<0.05, unpaired Student t test, XmAb23104-treated groups compared to XENP16432-treated group. Data were log transformed prior to statistical analysis.

FIG. 138 depicts the sequences for JTX-2011, produced in-house as XENP23058.

FIG. 139 depicts the sequences for XENP23057, an anti-ICOS mAb based on JTX-2011 with E233P/L234V/L235A/G236del/S267K ablation variants.

FIG. 140A to 140D depicts A) human CD45+ cell, B) human CD3+ T cell, C) human CD4+ T cell, and D) human CD8+ T cell counts in huPBMC-engrafted NSG mice on Day 21 after dosing with the indicated test articles.

DETAILED DESCRIPTION OF THE INVENTION

I. Nomenclature

The bispecific antibodies of the invention are listed in several different formats. Each polypeptide is given a unique "XENP" number, although as will be appreciated in the art, a longer sequence might contain a shorter one. For example, the heavy chain of the scFv side monomer of a bottle opener format for a given sequence will have a first XENP number, while the scFv domain will have a different XENP number. Some molecules have three polypeptides, so the XENP number, with the components, is used as a name. Thus, the molecule XENP, which is in bottle opener format, comprises three sequences, generally referred to as "XENP23104-HC-Fab", XENP23104 HC-scFv" and "XENP23104 LC" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the scFv side of XENP23104 (which binds PD-1) is "1G6_L1.194_H1.279", which indicates that the variable heavy domain H1.279 was combined with the light domain L1.194. In the case that these sequences are used as scFvs, the designation "1G6_L1.194_H1.279", indicates that the variable heavy domain H1.279 was combined with the light domain L1.194 and is in vl-linker-vh orientation, from N- to C-terminus. This molecule with the identical sequences of the heavy and light variable domains but in the reverse order would be named "1G6_H1.279_L1.194". Similarly, different constructs may "mix and match" the heavy and light chains as will be evident from the sequence listing and the Figures.

II. Incorporation of Materials

A. Figures and Legends

Specifically incorporated by reference are the Figures, Legends and Sequences from U.S. Ser. No. 62/479,723 and the Figures, Legends and Sequences from U.S. Ser. No. 15/623,314. In addition, the claims from U.S. Ser. No. 62/479,723 are additionally specifically incorporated.

B. Sequences

Target Antigens: The sequence of human PD-1 (sp|Q15116) is SEQ ID NO: 26226. The sequence of human PD-1, extracellular domain (sp|Q15116|21-170) is SEQ ID NO: 26227. The sequence of Macaca fascicularis PD-1 (tr|B0LAJ3) is SEQ ID NO: 26228. The sequence of Macaca fascicularis PD-1, extracellular domain (predicted) (tr|B0LAJ3|21-170) is SEQ ID NO: 26229. The sequence of human CTLA-4 (sp|P16410) is SEQ ID NO: 26230. The sequence of human CTLA-4, extracellular domain (sp|P16410|36-161) is SEQ ID NO: 26231. The sequence of Macaca fascicularis CTLA-4 (tr|G7PL88) is SEQ ID NO: 26232. The sequence of Macaca fascicularis CTLA-4, extracellular domain (predicted) (tr|G7PL88) is SEQ ID NO: 26233. The sequence of human LAG-3 (sp|P18627) is SEQ ID NO: 26234. The sequence of human LAG-3, extracellular domain (sp|P18627|29-450) is SEQ ID NO: 26235. The sequence of Macaca fascicularis LAG-3 (predicted) (gi|544467815|ref|XP_005570011.1) is SEQ ID NO: 26236. The sequence of Macaca fascicularis LAG-3, extracellular domain (predicted) (gi|544467815|ref|XP_005570011.1|29-450) is SEQ ID NO: 26237. The sequence of human TIM-3 (sp|Q8TDQ0) is SEQ ID NO: 26238. The sequence of human TIM-3, extracellular domain (sp|Q8TDQ0|22-202) is SEQ ID NO: 26239. The sequence of Macaca fascicularis TIM-3 (predicted) (gi|355750365|gb|EHH54703.1) is SEQ ID NO: 26240. The sequence of Macaca fascicularis TIM-3, extracellular domain (predicted) (gi|355750365|gb|EHH54703.1|22-203) is SEQ ID NO: 26241. The sequence of human PD-L1 (sp|Q9NZQ7) is SEQ ID NO: 26242. The sequence of human PD-L1, extracellular domain (sp|Q9NZQ7|19-238) is SEQ ID NO: 26243. The sequence of Macaca fascicularis PD-L1 (predicted) (gb|XP_005581836.1) is SEQ ID NO: 26244. The sequence of Macaca fascicularis PD-L1, extracellular domain (predicted) (gb|XP_005581836.1|19-238) is SEQ ID NO: 26245. The sequence of human ICOS (sp|Q9Y6W8) is SEQ ID NO: 26246. The sequence of human ICOS, extracellular domain (sp|Q9Y6W8|21-140) is SEQ ID NO: 26247. The sequence of Macaca fascicularis ICOS (gi|544477053|ref|XP_005574075.1) is SEQ ID NO: 26248. The sequence of Macaca fascicularis ICOS, extracellular domain (predicted) (gi|544477053|ref|XP_005574075.1|21-140) is SEQ ID NO: 26249. The sequence of human GITR (sp|Q9Y5U5) is SEQ ID NO: 26250. The sequence of human GITR, extracellular domain (sp|Q9Y5U5|26-162) is SEQ ID NO: 26251. The sequence of Macaca fascicularis GITR (predicted) (ref|XP_005545180.1) is SEQ ID NO: 26252. The sequence of Macaca fascicularis GITR, extracellular domain (predicted) (ref|XP_005545180.1|26-162) is SEQ ID NO: 26253. The sequence of human OX40 (sp|P43489) is SEQ ID NO: 26254. The sequence of human OX40, extracellular domain (sp|P43489|29-214) is SEQ ID NO: 26255. The sequence of Macaca fascicularis OX40 (predicted) (ref|XP_005545179.1) is SEQ ID NO: 26256. The sequence of Macaca fascicularis OX40, extracellular domain (predicted) (ref|XP_005545179.1|29-214) is SEQ ID NO: 26257. The sequence of human 4-1BB (sp|Q07011) is SEQ ID NO: 26258. The sequence of human 4-1BB, extracellular domain (sp|Q07011|24-186) is SEQ ID NO: 26259. The sequence of Macaca fascicularis 4-1BB (predicted) (ref|XP_005544945.1) is SEQ ID NO: 26260. The sequence of Macaca fascicularis 4-1BB, extracellular domain (predicted) (ref|XP_005544945.1|24-186) is SEQ ID NO: 26261.

ICOS binding domains: In addition the sequences shown in FIG. 19, FIG. 20 and FIG. 24, SEQ ID NO:27869-28086 contain a number of ICOS Fab sequences (heavy chain VH1-CH1 and light chain VL1-CL) as indicated in the naming nomenclature. Reference for the CDRs and for the junction between the variable junctions is shown in FIG. 40 of U.S. Ser. No. 62/479,723 (hereby incorporated by reference as well as the Legend), although from the SEQ listing one of skill in the art will be able to ascertain the CDRs (see Table 1 for numbering and/or through sequence alignment) as well as for the junctions (e.g. heavy chain CH1 generally starts with the sequence "ASTK . . . " (SEQ ID NO: 30380) and light chain constant domain generally starts with "RTVA . . . " (SEQ ID NO: 30381). SEQ ID NO:28087-28269 show the three sequences for "one armed mAb" (FIG. 2N; Fab-Fc, Fc only and light chain) as shown in the naming nomenclature. Reference for the CDRs and for the junction between the variable junctions is shown in FIG. 41 of U.S. Ser. No. 62/479,723 (hereby incorporated by reference as well as the Legend), although from the SEQ listing one of skill in the art will be able to ascertain the CDRs (see Table 1 for numbering and/or through sequence alignment) as well as for the junctions (e.g. heavy chain CH1 generally starts with the sequence "ASTK . . . " (SEQ ID NO: 30380) and light chain constant domain generally starts with "RTVA . . . " (SEQ ID NO: 30381). Additional one armed ICOS molecules are shown in FIG. 68. SEQ ID NO:28549-28556 show some control antibodies (HC and LC) from which the Fvs can be used as ICOS ABDs as well; reference for the CDRs and for the junction between the variable junctions is shown in FIG. 44 of U.S. Ser. No. 62/479,723 (hereby incorporated by reference as well as the Legend), although from the SEQ listing one of skill in the art will be able to ascertain the CDRs (see Table 1 for numbering and/or through sequence alignment) as well as for the junctions (e.g. heavy chain CH1 generally starts with the sequence "ASTK . . . " (SEQ ID NO: 30380) and light chain constant domain generally starts with "RTVA . . . " (SEQ ID NO: 30381). SEQ ID NO:28557-28665 show some ICOS scFvs that find use in combination in the invention; reference for the CDRs and for the junction between the variable junctions is shown in FIG. 45 of U.S. Ser. No. 62/479,723 (hereby incorporated by reference as well as the Legend), although from the SEQ listing one of skill in the art will be able to ascertain the CDRs (see Table 1 for numbering and/or through sequence alignment) as well as for the junctions, as the scFvs utilize the charged linker (GKPGS)$_4$ between (SEQ ID NO: 26209) the vh and vl domains. Thus, suitable ICOS ABDs for use in combination with ABDs for checkpoint receptors are shown in FIG. 19, FIG. 20, FIG. 24, FIG. 68 and FIG. 77 as well as SEQ ID NO: 27869-28086, 28087-28269, 27193-27335, 28549-28556 and 28557-28665, and [ICOS]_H0.66_L0 and [ICOS]_H0_L0.

In addition, suitable ICOS X PD-1 bottle opener sequences include those in FIG. 3 as well as those in SEQ ID NO:28270-28548, which correspond to the sequences depicted in FIGS. 42 and 43 of U.S. Ser. No. 62/479,723 (both of which are hereby incorporated by reference as well as the Legends and sequences therein), again using these figures to show CDRs, junctions, etc.

III. Overview

Therapeutic antibodies directed against immune immunomodulatory inhibitors such as PD-1 are showing great promise in limited circumstances in the clinic for the treatment of cancer. Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells-especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response.

Checkpoint inhibitor monoclonal antibodies bind to immunomodulatory inhibitor proteins such as PD-1, which under normal circumstances prevent or suppress activation of cytotoxic T cells (CTLs). By inhibiting the immunomodulatory protein, for example through the use of antibodies that bind these proteins, an increased T cell response against tumors can be achieved. That is, these cancer immunomodulatory proteins suppress the immune response; when the proteins are blocked, for example using antibodies to the immunomodulatory protein, the immune system is activated, leading to immune stimulation, resulting in treatment of conditions such as cancer and infectious disease. Antibodies to either the PD-1 protein or its binding partner, PD-L1, leads to T cell activation.

Another area of current interest for harnessing the patient's immune system to fight disease involves the co-stimulation of T cells using agonistic antibodies that bind to co-stimulatory proteins such as ICOS (Inducible T cell Co-Stimulator, also referred to as CD278) which adds a positive signal to overcome the negative signaling of the immune checkpoint proteins on the T-cells. ICOS is a type I transmembrane protein comprising an extracellular (Ig) V-like domain, and serves as the receptor for the B7h co-stimulatory molecule.

Recent work shows that some tumor infiltrating lymphocytes (TILs) co-express PD-1 and ICOS (see Gros, J. Clinical Invest. 124(5):2246 (2014)).

Bispecific antibodies, which can bind two different targets simultaneously, offer the potential to improve the selectivity of targeting TILs vs peripheral T cells, while also reducing cost of therapy. The bivalent interaction of an antibody with two targets on a cell surface should—in some cases—lead to a higher binding avidity relative to a monovalent interaction with one target at a time. Because of this, normal bivalent antibodies tend to have high avidity for their target on a cell surface. With bispecific antibodies, the potential exists to create higher selectivity for cells that simultaneously express two different targets, utilizing the higher avidity afforded by simultaneous binding to both targets.

Accordingly, the present invention provides bispecific immunomodulatory antibodies, that bind to cells expressing the two antigens and methods of activating T cells and/or NK cells to treat diseases such as cancer and infectious diseases, and other conditions where increased immune activity results in treatment.

Thus, the invention is directed, in some instances, to solving the issue of toxicity and expense of administering multiple antibodies by providing bispecific antibodies that bind to two different immunomodulatory molecules (one a checkpoint receptor and the other a costimulatory receptor) on a single cell and advantageously requiring administration of only one therapeutic substance.

Bispecific antibodies offer the opportunity to combine immune immunomodulatory blockade with costimulation in one molecule. However, it is not obvious what combination of immune immunomodulatory plus costimulatory protein or what binding stoichiometry (monovalent+monovalent, monovalent+bivalent, etc.) would be efficacious. Here we identify bispecific antibodies that binding monovalently to a costimulatory protein (such as ICOS) and monovalent binding to a checkpoint receptor (such as PD-1) that are capable of inducing robust T cell activation.

Surprisingly, while conventional wisdom states that monovalent antibodies do not result in agonism, the present work shows the unexpected results of agonism of the ICOS receptor with the monovalent bispecific antibodies of the invention. See Merchant et al., PNAS Jul. 23, 2013 E2987-E2996, "[w]hile initial screening of bivalent antibodies produced agonists of MET, engineering them into monovalent antibodies produces antagonists instead." This positive result with only monovalent binding to ICOS is unexpected because it is thought that at least bivalent binding to a costimulatory protein is necessary to provide the required level of receptor clustering on the cell surface for triggering signaling. As shown by Fos et al., J. Immunol. 2008:1969-1977, ICOS ligation induces AKT phosphorylation. The studies here in use AKT phosphorylation as an indicator of ICOS agonism, and this effect is seen for both "one armed ICOS" (see Example 5A(a)) and for bispecific antibodies that bind ICOS monovalently. As shown in Example 7 and in FIG. 70, the one-arm XENP20266 that only binds ICOS monovalently promotes more AKT phosphorylation than XENP16435, which binds ICOS bivalently (e.g. as a traditional mAb).

Accordingly, the present invention is directed to novel constructs to provide heterodimeric, bispecific antibodies that allow binding to a checkpoint receptor as well as human ICOS.

Note that generally these bispecific antibodies are named "anti-PD-1 X anti-ICOS", or generally simplistically or for ease (and thus interchangeably) as "PD-1 X ICOS", etc. for each pair.

The heterodimeric bispecific immunomodulatory antibodies of the invention are useful to treat a variety of types of cancers. As will be appreciated by those in the art, in contrast to traditional monoclonal antibodies that bind to tumor antigens, or to the newer classes of bispecific antibodies that bind, for example, CD3 and tumor antigens (such as described in U.S. Ser. No. 15/141,350, for example), immunomodulatory antibodies are used to increase the immune response but are not generally tumor specific in their action. That is, the bispecific immunomodulatory antibodies of the invention inhibit the suppression of the immune system, generally leading to T cell activation, which in turn leads to greater immune response to cancerous cells and thus treatment.

As discussed below, there are a variety of ways that T cell activation can be measured. Functional effects of the bispecific immunomodulatory antibodies on NK and T-cells can be assessed in vitro (and in some cases in vivo, as described more fully below) by measuring changes in the following parameters: proliferation, cytokine release and cell-surface makers. For NK cells, increases in cell proliferation, cytotoxicity (ability to kill target cells as measured by increases in CD107a, granzyme, and perforin expression, or by directly measuring target cells killing), cytokine production (e.g. IFN-γ and TNF), and cell surface receptor expression (e.g. CD25) is indicative of immune modulation, e.g. enhanced killing of cancer cells. For T-cells, increases in proliferation, increases in expression of cell surface markers of activation (e.g. CD25, CD69, CD137, and PD1), cytotoxicity (ability to kill target cells), and cytokine production (e.g. IL-2, IL-4, IL-6, IFN, TNF-a, IL-10, IL-17A) are indicative of immune modulation, e.g. enhanced killing of cancer cells. Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells, (xii) increases in IL-2 secretion.

Thus, in some embodiments the invention provides the use of bispecific immunomodulatory antibodies to perform one or more of the following in a subject in need thereof: (a) upregulating pro-inflammatory cytokines; (b) increasing T-cell proliferation and/or expansion; (c) increasing interferon-γ or TNF-α production by T-cells; (d) increasing IL-2 secretion; (e) stimulating antibody responses; (f) inhibiting cancer cell growth; (g) promoting antigenic specific T cell immunity; (h) promoting CD4+ and/or CD8+ T cell activation; (i) alleviating T-cell suppression; (j) promoting NK cell activity; (k) promoting apoptosis or lysis of cancer cells; and/or (l) cytotoxic or cytostatic effect on cancer cells.

Accordingly, the present invention provides bispecific immunomodulatory antibodies. There are a number of formats that can be used in the present invention, as generally shown in FIG. 2, many of which are heterodimeric (although not all, as DVD-Ig, for example).

The heterodimeric antibodies constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric antibodies, which can co-engage two antigens in several ways, relying on amino acid variants in the constant regions that are different on each chain to promote heterodimeric formation and/or allow for ease of purification of heterodimers over the homodimers.

Thus, the present invention provides bispecific immunomodulatory antibodies. An ongoing problem in antibody technologies is the desire for "bispecific" antibodies that bind to two (or more) different antigens simultaneously, in general thus allowing the different antigens to be brought into proximity and resulting in new functionalities and new therapies. In general, these antibodies are made by including genes for each heavy and light chain into the host cells (generally, in the present invention, genes for two heavy chain monomers and a light chain as outlined herein). This generally results in the formation of the desired heterodimer (A-B), as well as the two homodimers (A-A and B-B). However, a major obstacle in the formation of bispecific antibodies is the difficulty in purifying the heterodimeric antibodies away from the homodimeric antibodies and/or biasing the formation of the heterodimer over the formation of the homodimers.

To solve this issue, there are a number of mechanisms that can be used to generate the heterodimers of the present invention. In addition, as will be appreciated by those in the art, these mechanisms can be combined to ensure high heterodimerization. Thus, amino acid variants that lead to the production of heterodimeric antibodies are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers.

One mechanism is generally referred to in the art as "knobs and holes" ("KIH") or sometimes herein as "skew" variants, referring to amino acid engineering that creates steric influences to favor heterodimeric formation and disfavor homodimeric formation can also optionally be used; this is sometimes referred to as "knobs and holes", as described in Ridgway et al., Protein Engineering 9(7):617 (1996); Atwell et al., J. Mol. Biol. 1997 270:26; U.S. Pat. No. 8,216,805, US 2012/0149876, all of which are hereby incorporated by reference in their entirety. The Figures identify a number of "monomer A-monomer B" pairs that include "knobs and holes" amino acid substitutions. In addition, as described in Merchant et al., Nature Biotech. 16:677 (1998), these "knobs and hole" mutations can be combined with disulfide bonds to skew formation to heterodimerization. Of use in the present invention are T366S/L368A/Y407V paired with T366W, as well as this variant with a bridging disulfide, T366S/L368A/Y407V/Y349C paired with T366W/S354C, particularly in combination with other heterodimerization variants including pI variants as outlined below.

An additional mechanism that finds use in the generation of heterodimeric antibodies is sometimes referred to as "electrostatic steering" or "charge pairs" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R and others shown in the Figures.

In the present invention, in some embodiments, pI variants are used to alter the pI of one or both of the monomers and thus allowing the isoelectric purification of A-A, A-B and B-B dimeric proteins.

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, some scaffold formats, such as the "triple F" or "bottle opener" format, also allows separation on the basis of size. As is further outlined below, it is also possible to "skew" the formation of heterodimers over homodimers. Thus, a combination of steric heterodimerization variants and pI or charge pair variants find particular use in the invention. Additionally, as more fully outlined below, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide the use of skew variants with charged scFv linkers as well (and combinations of Fc, FcRn and KO variants discussed herein).

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine). A number of these variants are shown in the Figures. In addition, suitable pI variants for use in the creation of heterodimeric antibodies herein are those that are isotypic, e.g. importing pI variants from different IgG isotypes such that pI is changed without introducing significant immunogenicity; see FIG. 29 from US Publication No. 20140288275, hereby incorporated by reference in its entirety.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A–+B or wt A– –B), or by increasing one region and decreasing the other region (A+–B– or A–B+).

Thus, in general, a component of some embodiments of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein. Furthermore, as will be appreciated by those in the art and outlined herein, in some cases (depending on the format) heterodimers can be separated from homodimers on the basis of size (e.g. Molecular weight). For example, as shown in some embodiments of FIG. 2, some formats result in homodimers and heterodimers with different sizes (e.g. for bottle openers, one homodimer is a "dual scFv" format, one homodimer is a standard antibody, and the heterodimer has one Fab and one scFv).

In the case where pI variants are used to achieve purified heterodimers over homodimers, by using the constant region (s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as the ability to either eliminate, minimize and distinguish when homodimers are present is significant. Similarly, the ability to reliably test the reproducibility of the heterodimeric protein production is important.

First and second antigens of the invention are herein referred to as antigen-1 and antigen-2 respectively, with one being a costimulatory receptor and one being a checkpoint receptor. One heterodimeric scaffold that finds particular use in the present invention is the "triple f" or "bottle opener" scaffold format. In this embodiment, one heavy chain of the antibody contains an single chain fv ("scfv", as defined below) and the other heavy chain is a "regular" fab format, comprising a variable heavy chain and a light chain. This structure is sometimes referred to herein as "triple f" format (scfv-fab-fc) or the "bottle-opener" format, due to a rough visual similarity to a bottle-opener (see FIG. 2). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

Furthermore, as outlined herein, additional amino acid variants may be introduced into the bispecific antibodies of the invention, to add additional functionalities. For example, amino acid changes within the Fc region can be added (either to one monomer or both) to facilitate increased ADCC or CDC (e.g. altered binding to Fcγ receptors) as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, it is generally desirable to ablate FcγRIIIa binding to eliminate or significantly reduce ADCC activity. Suitable ablation variants are shown in FIG. 6.

IV. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 6.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "immunomodulatoryantigen binding domain" binds a target immunomodulatoryantigen as outlined herein. As is known in the art, these CDRs are generally present as a first set of variable heavy CDRs (vhCDRs or $V_H$CDRs) and a second set of variable light CDRs (vlCDRs or $V_L$CDR5), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker as outlined herein, into a single polypeptide sequence, which can be either (starting from the N-terminus) vh-linker-vl or vl-linker-vh, with the former being generally preferred (including optional domain linkers on each side, depending on the format used.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAsp-Glu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid can be included. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and noreleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CHL VL, and CL immunoglobulin domains. Fab may refer to this region in isolation, or this region in the context of a full length antibody, antibody fragment or Fab fusion protein.

By "Fv" or "Fv fragment" or "Fv region" as used herein is meant a polypeptide that comprises the VL and VH domains of a single ABD. As will be appreciated by those in the art, these generally are made up of two chains, or can be combined (generally with a linker as discussed herein) to form an scFv. In some cases, for example in the "central-Fv"

and "DVD-Ig" formats, an "extra" vh and vl domain is added that serves as a scFv but where the vh and vl domains are not linked using a scFv linker between them.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh).

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are shown in the Figure Legend of FIG. 83.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "Fc fusion protein" or "immunoadhesin" herein is meant a protein comprising an Fc region, generally linked (optionally through a linker moiety, as described herein) to a different protein, such as a binding moiety to a target protein, as described herein. In some cases, one monomer of the heterodimeric antibody comprises an antibody heavy chain (either including an scFv or further including a light chain) and the other monomer is a Fc fusion, comprising a variant Fc domain and a ligand. In some embodiments, these "half antibody-half fusion proteins" are referred to as "Fusionbodies".

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. A target antigen may be a protein, carbohydrate, lipid, or other chemical compound. Suitable target antigens are described below.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs 0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10'$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore assay.

V. Antibodies

The present invention relates to the generation of bispecific immunomodulatory antibodies that bind two different immunomodulatory antigens as discussed herein. As is discussed below, the term "antibody" is used generally. Antibodies that find use in the present invention can take on a number of formats as described herein.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to bispecific antibodies that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one of the cysteines at position 220 replaced by a serine; generally, this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3).

A useful comparison of CDR numbering is as below, see Lafranc et al., Dev. Comp. Immunol. 27(1):55-77 (2003):

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the

TABLE 1

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 | variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain. In the embodiments herein, when a scFv is attached to an Fc domain, it is the C-terminus of the scFv construct that is attached to all or part of the hinge of the Fc domain; for example, it is generally attached to the sequence EPKS which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, C-terminus of the variable light chain is attached to the N-terminus of the scFv linker, the C-terminus of which is attached to the N-terminus of a variable heavy chain (N-vh-linker-vl-C) although that can be switched (N-vl-linker-vh-C). Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIG. 2).

As shown herein, there are a number of suitable scFv linkers that can be used, including traditional peptide bonds, generated by recombinant techniques. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 30382), (GGGGS)n (SEQ ID NO: 30383), and (GGGS)n (SEQ ID NO: 30384), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO: 30382), (GGGGS)n (SEQ ID NO: 30383), and (GGGS)n (SEQ ID NO: 30384), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the scFv linker is a charged scFv linker, a number of which are shown in FIG. 8. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 8 can be used in any embodiment herein where a linker is utilized.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. In particular, the formats depicted in FIG. 1 are antibodies, usually referred to as "heterodimeric antibodies", meaning that the protein has at least two associated Fc sequences self-assembled into a heterodimeric Fc domain and at least two Fv regions, whether as Fabs or as scFvs.

A. Chimeric and Humanized Antibodies

In some embodiments, the antibodies herein can be derived from a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference.

In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J.

Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VI. Heterodimeric Antibodies

Accordingly, in some embodiments the present invention provides heterodimeric immunomodulatory antibodies that rely on the use of two different heavy chain variant Fc sequences, that will self-assemble to form heterodimeric Fc domains and heterodimeric antibodies.

The present invention is directed to novel constructs to provide heterodimeric antibodies that allow binding to more than one immunomodulatory antigen or ligand, e.g. to allow for bispecific binding. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric immunomodulatory antibodies which can co-engage antigens in several ways, relying on amino acid variants in the constant regions that are different on each chain to promote heterodimeric formation and/or allow for ease of purification of heterodimers over the homodimers.

Thus, the present invention provides bispecific antibodies. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (e.g. aspartic acid to lysine) or changing a charged residue to a neutral residue (e.g. loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A–+B or wt A––B), or by increasing one region and decreasing the other region (A+–B– or A–B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies" by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein. Furthermore, as will be appreciated by those in the art and outlined herein, in some embodiments, heterodimers can be separated from homodimers on the basis of size. As shown in FIG. 2, for example, several of the formats allow separation of heterodimers and homodimers on the basis of size.

A. Heterodimerization Variants

The present invention provides heterodimeric proteins, including heterodimeric antibodies in a variety of formats, which utilize heterodimeric variants to allow for heterodimeric formation and/or purification away from homodimers. A number of heterodimerization variants are shown in FIG. 4.

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the Figures.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 4 showing some pairs of particular utility in many embodiments. Of particular use in many embodiments are the pairs of sets including, but not limited to, S364K/E357Q: L368D/K370S; L368D/K370S: S364K; L368E/K370S: S364K; T411T/E360E/Q362E: D401K; L368D/K370S: S364K/E357L, K370S: S364K/E357Q and T366S/L368A/Y407V: T366W (optionally including a bridging disulfide, T366S/L368A/Y407V/Y349C: T366W/S354C). In terms of nomenclature, the pair "S364K/E357Q: L368D/K370S" means that one of the monomers has the double variant set S364K/E357Q and the other has the double variant set L368D/K370S; as above, the "strandedness" of these pairs depends on the starting pI.

C. pI (Isoelectric point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 5. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the bottle opener format, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)4 (SEQ ID NO: 26209). However, as will be appreciated by those in the art, the first monomer includes a CH1 domain, including position 208. Accordingly, in constructs that do not include a CH1 domain (for example for heterodimeric Fc fusion proteins that do not utilize a CH1 domain on one of the domains, for example in a dual scFv format), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 5 and the other monomer has a charged linker (either in the form of a charged scFv linker because that monomer comprises an scFv or a charged domain linker, as the format dictates).

1. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

D. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

E. pI Variants that also confer better FcRn in vivo binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

F. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

G. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), U.S. Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

H. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in FIG. 6, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

I. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

VII. Useful Formats of the Invention

As will be appreciated by those in the art and discussed more fully below, the bispecific heterodimeric antibodies of the present invention can take on a wide variety of configurations, as are generally depicted in FIG. 2. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats (see FIG. 2) of the invention can have different valencies as well as be bispecific. That is, antibodies of the invention can be bivalent and bispecific, wherein a checkpoint target is bound by one ABD and the costimulatory target is bound by a second ABD (see for example the bottle opener format which is heterodimeric) or the bispecific mAb which is homodimeric). The heterodimeric antibodies can also be trivalent and bispecific, wherein the first antigen is bound by two ABDs and the second antigen by a second ABD (see for example the Central-scFv format and the trident format). The heterodimeric antibodies can also be bispecific and tetravalent (such as the Central scFv2 format and the DVD-Ig format).

Again, with the exception of the DVD-Ig format and the central-scFv2 format, the antibodies are generally formatted such that the co-stimulatory target is bound monovalently.

A. Bottle Opener Format

One heterodimeric scaffold that finds particular use in the present invention is the "triple F" or "bottle opener" scaffold format. In this embodiment, one heavy chain of the antibody contains a single chain Fv ("scFv", as defined below) and the other heavy chain is a "regular" Fab format, comprising a variable heavy chain and a light chain. This structure is sometimes referred to herein as "triple F" format (scFv-Fab-Fc) or the "bottle-opener" format, due to a rough visual similarity to a bottle-opener. The two chains are brought together by the use of amino acid variants in the constant regions (e.g. the Fc domain, the CH1 domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the bottle opener format that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker (which, as outlined herein can either be un-charged or charged and can be exogeneous or endogeneous (e.g. all or part of the native hinge domain). The second monomer of the bottle opener format is a heavy chain, and the composition further comprises a light chain.

In addition, the Fc domains of the bottle opener format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the bottle opener format includes skew variants, pI variants, and ablation variants. Accordingly, some embodiments include bottle opener formats that comprise: a) a first monomer (the "scFv monomer") that comprises a charged scFv linker (with the +H sequence of FIG. 8 being preferred in some embodiments), the skew variants S364K/E357Q, the ablation variants E233P/L234V/L235A/G236del/S267K, and an Fv that binds to one target as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second target as outlined herein; and c) a light chain. In this particular embodiment, suitable monomer Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

Accordingly, some embodiments include bottle opener formats that comprise: a) a first monomer (the "scFv monomer") that comprises a charged scFv linker (with the +H sequence of FIG. 8 being preferred in some embodiments), the skew variants S364K/E357Q, the ablation variants E233P/L234V/L235A/G236del/S267K, and an Fv that binds to one target as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second target as outlined herein; and c) a light chain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the bottle opener format includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 8 being preferred in some embodiments), the skew variants S364K/E357Q, the ablation variants E233P/L234V/L235A/G236del/S267K, the FcRn variants M428L/N434S and an Fv that binds to a first receptor (either a costimulatory or checkpoint receptor) as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second receptor as outlined herein (the other of the costimulatory or checkpoint receptor); and c) a light chain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

Specifically, FIG. 9 shows some bottle opener "backbone" sequences that are missing the Fv sequences that can be used in the present invention. That is, Fv sequences for the scFv portion and the Fab portion can be used from any combination of ICOS and PD-1, ICOS and CTLA-4, ICOS and LAG-3, ICOS and TIM-3, ICOS and PD-L1, ICOS and BTLA, ICOS and TIGIT, GITR and TIGIT, GITR and PD-1, GITR and CTLA-4, GITR and LAG-3, GITR and TIM-3, GITR and PD-L1, GITR and BTLA, OX40 and PD-1, OX40 and TIGIT, OX40 and CTLA-4, IC OX40 OS and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1, TIGIT and 4-1BB and 4-1BB and BTLA, in combination with any or all of backbones 1 to 10, with backbone 1 of particular use in these combinations.

For bottle opener backbone 1 from FIG. 9 (optionally including the 428L/4345 variants) specific Fv combinations of use in the present invention include ICOS and PD-1, ICOS and PD-L1 and ICOS and CTLA-4.

For bottle opener backbone 1 from FIG. 9 (optionally including the 428L/4345 variants) specific ABDs that bind human ICOS include, but are not limited to, [ICOS]_H0L0 and [ICOS]H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

For bottle opener backbone 1 from FIG. 9 (optionally including the 428L/4345 variants), specific ABDs that bind human GITR include, but are not limited to, those in FIG. 18, FIG. 72 and FIG. 73 and those listed in SEQ ID NO:26282-26290.

For bottle opener backbone 1 from FIG. 9 (optionally including the 428L/4345 variants), specific ABDs that bind OX40 include, but are not limited to, FIG. 17, FIG. 72 and FIG. 73 and those listed in SEQ ID NO: 26272-26281.

For bottle opener backbone 1 from FIG. 9 (optionally including the 428L/4345 variants), specific ABDs that bind human 4-1BB include, but are not limited to, FIG. 16, FIG. 72 and FIG. 73 and SEQ ID NO: 26262-2671.

For bottle opener backbone 1 from FIG. 9 (optionally including the 428L/4345 variants), specific ABDs that bind human PD-L1 include, but are not limited to, FIG. 15, FIG. 73 and FIG. 78 and SEQ ID NO: 3961-4432.

Specific bottle opener embodiments are outlined below.

B. mAb-Fv format

One heterodimeric scaffold that finds particular use in the present invention is the mAb-Fv format. In this embodiment, the format relies on the use of a C-terminal attachment of an "extra" variable heavy domain to one monomer and the C-terminal attachment of an "extra" variable light domain to the other monomer, thus forming a third antigen binding domain (i.e. an "extra" Fv domain), wherein the Fab portions of the two monomers bind one checkpoint target and the "extra" Fv domain binds a costimulatory target.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (vh1-CH1-hinge-CH2-CH3-[optional linker]-vl2). The second monomer comprises a second variable heavy domain, a second constant heavy domain comprising a second Fc domain, and a third variable heavy domain covalently attached to the C-terminus of the second Fc domain using a domain linker (vh1-CH1-hinge-CH2-CH3-[optional linker]-vh2). This embodiment further utilizes a common light chain comprising a variable light domain and a constant light domain, which associates with the heavy chains to form two identical Fabs that include two identical Fvs. The two C-terminally attached variable domains make up the "extra" third Fv. As for many of the embodiments herein, these constructs include skew variants, pI variants, ablation variants, additional Fc variants, etc. as desired and described herein. In this embodiment, suitable Fv pairs include (Fabs listed first, "extra" Fv listed second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the mAb-Fv format comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first receptor (either a costimulatory receptor or a checkpoint receptor) as outlined herein, and a second variable light chain, that together with the second variable heavy chain forms an Fv (ABD) that binds a second receptor (e.g. the other of the costimulatory or checkpoint receptor; and c) a light chain comprising a first variable light domain and a constant light domain. Of particular use in some embodiments in this format, are (Fab-scFv order) ICOS X PD-1, PD-1 X ICOS, PD-L1 X ICOS, ICOS x PD-L1, GITR X PD-1, OX40 X PD-1 and 4-1BB X PD-1. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) ICOS X PD-1, ICOS x PD-L1, GITR X PD-1, OX40 X PD-1 and 4-1BB X PD-1.

For mAb-Fv sequences that are similar to the mAb-scFv backbone 1 (optionally including M428L/N434S) from FIG. 75, specific ABDs that bind human ICOS are [ICOS]_H0L0 and [ICOS]_H0.66_L0, as well as those shown in FIG. 19, FIG. 20, FIG. 24, FIG. 68 and FIG. 77 as well as SEQ ID NO: 27869-28086, 28087-28269, 27193-27335, 28549-28556 and 28557-28665.

For mAb-Fv sequences that are similar to the mAb-scFv backbone 1 (optionally including M428L/N434S) from FIG. 75, specific ABDs that bind human PD-L1 are shown in FIG. 15, FIG. 73 and FIG. 78 and SEQ ID NO: 3961-4432.

For mAb-Fv sequences that are similar to the mAb-scFv backbone 1 (optionally including M428L/N434S) from FIG. 75, specific ABDs that bind human GITR are those in FIG. 18, FIG. 72 and FIG. 73 and those listed in SEQ ID NO:26282-26290.

For mAb-Fv sequences that are similar to the mAb-scFv backbone 1 (optionally including M428L/N434S) from FIG. 75, specific ABDs that bind human 4-1BB are those in FIG. 16, FIG. 72 and FIG. 73 and SEQ ID NO: 26262-2671.

For mAb-Fv sequences that are similar to the mAb-scFv backbone 1 (optionally including M428L/N434S) from FIG. 75, specific ABDs that bind human OX40 are those in FIG. 17, FIG. 72 and FIG. 73 and those listed in SEQ ID NO: 26272-26281.

For mAb-Fv sequences that are similar to the mAb-scFv backbone 1 (optionally including M428L/N434S) from FIG. 75, specific ABDs that bind human PD-L1 from FIG. 15, FIG. 73 and FIG. 78 and SEQ ID NO: 3961-4432.

C. mAb-scFv

One heterodimeric scaffold that finds particular use in the present invention is the mAb-scFv format. In this embodiment, the format relies on the use of a C-terminal attachment of an scFv to one of the monomers, thus forming a third antigen binding domain, wherein the Fab portions of the two monomers bind one receptor target and the "extra" scFv domain binds the other receptor target (generally the monovalently bound costimulatory receptor).

In this embodiment, the first monomer comprises a first heavy chain (comprising a variable heavy domain and a constant domain), with a C-terminally covalently attached scFv comprising a scFv variable light domain, an scFv linker and a scFv variable heavy domain in either orientation (vh1-CH1-hinge-CH2-CH3-[optional linker]-vh2-scFv linker-vl2 or vh1-CH1-hinge-CH2-CH3-[optional linker]-vl2-scFv linker-vh2). This embodiment further utilizes a common light chain comprising a variable light domain and a constant light domain, which associates with the heavy chains to form two identical Fabs that bind one of the target receptors. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the mAb-scFv format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/ Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the mAb-scFv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first receptor, and a scFv that binds to the second receptor; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first receptor as outlined herein; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first receptor, and a scFv that binds to the second receptor; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and c) a light chain comprising a first variable light domain and a constant light domain.

In mAb-scFv backbone 1 (optionally including M428L/N434S) from FIG. 75, specific ABDs that bind human ICOS are shown in FIG. 19, FIG. 20, FIG. 24, FIG. 68 and FIG. 77 as well as SEQ ID NO: 27869-28086, 28087-28269, 27193-27335, 28549-28556 and 28557-28665.

In mAb-scFv backbone 1 (optionally including M428L/N434S) from FIG. 75, specific ABDs that bind human GITR are those in FIG. 18, FIG. 72 and FIG. 73 and those listed in SEQ ID NO:26282-26290.

In mAb-scFv backbone 1 (optionally including M428L/N434S) from FIG. 75, specific ABDs that bind human 4-1BB include those in FIG. 16, FIG. 72 and FIG. 73 and SEQ ID NO: 26262-2671.

In mAb-scFv backbone 1 (optionally including M428L/N434S) from FIG. 75, specific ABDs that bind human OX-40 FIG. 17, FIG. 72 and FIG. 73 and those listed in SEQ ID NO: 26272-26281.

In mAb-scFv backbone 1 (optionally including M428L/N434S) from FIG. 75, specific ABDs that bind human PD-L1 include FIG. 15, FIG. 73 and FIG. 78 and SEQ ID NO: 3961-4432.

D. Central scFv

One heterodimeric scaffold that finds particular use in the present invention is the Central-scFv format. In this embodiment, the format relies on the use of an inserted scFv domain thus forming a third antigen binding domain, wherein the Fab portions of the two monomers bind one receptor target and the "extra" scFv domain binds another (again, generally the costimulatory receptor is bound monovalently). The scFv domain is inserted between the Fc domain and the CH1-Fv region of one of the monomers, thus providing a third antigen binding domain.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (vh1-CH1-[optional linker]-vh2-scFv linker-vl2-[optional linker including the hinge]-CH2-CH3, or the opposite orientation for the scFv, vh1-CH1-[optional linker]-vl2-scFv linker-vh2-[optional linker including the hinge]-CH2-CH3). In some embodiments, the optional linker is a hinge or fragment thereof. The other monomer is a standard Fab side (e.g. vh1-CH1-hinge-CH2-CH3). This embodiment further utilizes a common light chain comprising a variable light domain and a constant light domain, which associates with the heavy chains to form two identical Fabs that bind a checkpoint inhibitor. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the central scFv format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the central scFv format includes skew variants, pI variants, and ablation variants. Accordingly, some embodiments include central scFv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first receptor; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the second receptor as outlined herein; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the central scFv format includes skew variants, pI variants, ablation variants and FcRn variants. Accordingly, some embodiments include central-scFv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first receptor and an scFv domain that binds to a second receptor; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein; and c) a light chain comprising a first variable light domain and a constant light domain. In this embodiment, suitable Fv pairs include (Fabs listed first, scFvs second) ICOS X PD-1, PD-1 X ICOS, ICOS X PD-L1, PD-L1 X ICOS, ICOS X CTLA-4 and CTLA-4 X ICOS.

For central-scFv sequences that utilize the central-scFv sequences of FIGS. 55A-55D suitable Fvs that bind ICOS include, but are not limited to, shown in FIG. 19, FIG. 20, FIG. 24, FIG. 68 and FIG. 77 as well as SEQ ID NO: 27869-28086, 28087-28269, 27193-27335, 28549-28556 and 28557-28665.

For central-scFv sequences that utilize the central-scFv sequences of FIGS. 55A-55D suitable Fvs that bind PD-L1 include, but are not limited to, those shown in FIG. 15, FIG. 73 and FIG. 78 and SEQ ID NO: 3961-4432.

For central-scFv sequences that utilize the central-scFv sequences of FIGS. 55A-55D suitable Fvs that bind GITR include, but are not limited to, those in FIG. 18, FIG. 72 and FIG. 73 and those listed in SEQ ID NO:26282-26290.

For central-scFv sequences that utilize the central-scFv sequences of FIGS. 55A-55D suitable Fvs that bind OX40 include, but are not limited to, FIG. 17, FIG. 72 and FIG. 73 and those listed in SEQ ID NO: 26272-26281.

For central-scFv sequences that utilize the central-scFv sequences of FIGS. 55A-55D suitable Fvs that bind 4-1BB include, but are not limited to, FIG. 16, FIG. 72 and FIG. 73 and SEQ ID NO: 26262-2671.

E. Central-scFv2

One heterodimeric scaffold that finds particular use in the present invention is the Central-scFv2 format, which is bispecific and tetravalent. In this embodiment, the format relies on the use of two inserted scFv domains thus forming third and fourth antigen binding domains, wherein the Fab portions of the two monomers bind one receptor target and the "extra" scFv domains bind another. The scFv domain is inserted between the Fc domain and the CH1-Fv region of the monomers.

In this embodiment, both monomers comprise a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (vh1-CH1-[optional linker]-vh2-scFv linker-vl2-[optional linker including the hinge]-CH2-CH3, or the opposite orientation for the scFv, vh1-CH1-[optional linker]-vl2-scFv linker-vh2-[optional linker including the hinge]-CH2-CH3). In some embodiments, the optional linker is a hinge or fragment thereof. This embodiment further utilizes a common light chain comprising a variable light domain and a constant light domain, which associates with the heavy chains to form two identical Fabs that bind a receptor. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the central scFv2 format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the central scFv2 format includes skew variants, pI variants, and ablation variants. Accordingly, some embodiments include central scFv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first receptor; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the second receptor as outlined herein; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the central scFv2 format includes skew variants, pI variants, ablation variants and FcRn variants. Accordingly, some embodiments include central-scFv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first receptor and an scFv domain that binds to a second receptor; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein; and c) a light chain comprising a first variable light domain and a constant light domain. In this embodiment, suitable Fv pairs include (Fabs listed first, scFvs second) ICOS X PD-1, PD-1 X ICOS, ICOS X PD-L1, PD-L1 X ICOS, ICOS X CTLA-4 and CTLA-4 X ICOS.

For central-scFv2 sequences that utilize the central-scFv2 sequences of FIGS. 55A-55D suitable Fvs that bind ICOS include, but are not limited to, shown in FIG. 19, FIG. 20, FIG. 24, FIG. 68 and FIG. 77 as well as SEQ ID NO: 27869-28086, 28087-28269, 27193-27335, 28549-28556 and 28557-28665.

For central-scFv2 sequences that utilize the central-scFv2 sequences of FIGS. 55A-55D suitable Fvs that bind PD-L1 include, but are not limited to, those shown in FIG. 15, FIG. 73 and FIG. 78 and SEQ ID NO: 3961-4432.

For central-scFv2 sequences that utilize the central-scFv sequences of FIGS. 55A-55D suitable Fvs that bind GITR include, but are not limited to, those in FIG. 18, FIG. 72 and FIG. 73 and those listed in SEQ ID NO:26282-26290.

For central-scFv2 sequences that utilize the central-scFv sequences of FIGS. 55A-55D suitable Fvs that bind OX40 include, but are not limited to, FIG. 17, FIG. 72 and FIG. 73 and those listed in SEQ ID NO: 26272-26281.

For central-scFv2 sequences that utilize the central-scFv sequences of FIGS. 55A-55D suitable Fvs that bind 4-1BB include, but are not limited to, FIG. 16, FIG. 72 and FIG. 73 and SEQ ID NO: 26262-2671.

F. One Armed mAb

As noted above, surprisingly and unexpectedly, monovalent costimulatory antibodies comprising a single ABD to the target show efficacy in activating T cells.

Accordingly, in some embodiments, the invention provides monovalent, monospecific antibodies as shown in Figure FIG. 2N that comprise a heterodimeric Fc domain (for stability). In this embodiment, in this embodiment, one monomer comprises just an Fc domain, while the other monomer is a HC (VH1-CH1-hinge-CH2-CH3). This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein. In this embodiment, suitable ABDs bind a costimulatory receptor such as ICOS, GITR, OX40 or 4-1BB.

The ABD sequences for these combinations can be as disclosed in the sequence listing or as shown in the Figures.

In addition, the Fc domains of the comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), and the heavy chain comprises pI variants (including those shown in FIG. 5).

In some embodiments, the one armed scFv-mAb format includes skew variants, pI variants, and ablation variants. Accordingly, some embodiments include formats that comprise: a) a first (Fc) monomer that comprises the skew variants S364K/E357Q, the ablation variants E233P/L234V/L235A/G236del/S267K b) a second monomer that comprises the skew variants L368D/K370S, the pI variants Q295E/N384D/Q418E/N421D, the ablation variants E233P/L234V/L235A/G236del/S267K, and a first variable heavy domain that, with the first variable light domain, makes up the Fv that binds to the costimulatory receptor as outlined herein In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

Specific "one armed mAbs" are shown in the Figures and sequence listing.

G. Bispecific mAb

One heterodimeric scaffold that finds particular use in the present invention is the bispecific mAb format, which is bispecific and tetravalent. In this embodiment, the format relies on the generation of separate homodimeric antibodies which are then recombined. In this format, there is one HC-LC pair (VH1-CH1-hinge-CH2-CH3 and VL1-LC) and a second Hc-LC pair (VH2-CH1-hinge-CH2-CH3 and VL2-LC), e.g. two different heavy chains and two different light chains. Reference is made to Example 5I(d).

In this format, suitable pairs include ICOS and PD-1, ICOS and CTLA-4, ICOS and LAG-3, ICOS and TIM-3, ICOS and PD-L1, ICOS and BTLA, ICOS and TIGIT, GITR and TIGIT, GITR and PD-1, GITR and CTLA-4, GITR and LAG-3, GITR and TIM-3, GITR and PD-L1, GITR and BTLA, OX40 and PD-1, OX40 and TIGIT, OX40 and CTLA-4, IC OX40 OS and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1, TIGIT and 4-1BB and 4-1BB and BTLA.

In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the ABD comprising the ABD 1G6_L1.194_H1.279 that binds to PD-1;

(3) the format comprises an ICOS ABD of H0.66_L0 combined with the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

H. Central-Fv Format

One heterodimeric scaffold that finds particular use in the present invention is the Central-Fv format shown in FIG. 2. In this embodiment, the format relies on the use of an inserted Fv domain thus forming an "extra" third antigen binding domain, wherein the Fab portions of the two monomers bind one receptor and the "extra" central-Fv domain binds another (generally the costimulatory receptor). The Fv domain is inserted between the Fc domain and the CH1-Fv region of the monomers, thus providing a third antigen binding domain, wherein each monomer contains a component of the Fv (e.g. one monomer comprises a variable heavy domain and the other a variable light domain of the "extra" central Fv domain).

In this embodiment, one monomer comprises a first heavy chain comprising a first variable heavy domain, a CH1 domain, and Fc domain and an additional variable light domain. The additional variable light domain is covalently attached between the C-terminus of the CH1 domain of the heavy constant domain and the N-terminus of the first Fc domain using domain linkers (vh1-CH1-[optional linker]-vl2-hinge-CH2-CH3). The other monomer comprises a first heavy chain comprising a first variable heavy domain, a CH1 domain and Fc domain and an additional variable heavy domain (vh1-CH1-[optional linker]-vh2-hinge-CH2-CH3). The additional variable heavy domain is covalently attached between the C-terminus of the CH1 domain of the heavy constant domain and the N-terminus of the first Fc domain using domain linkers. This embodiment utilizes a common light chain comprising a variable light domain and a constant light domain, that associates with the heavy chains to form two identical Fabs that each bind a receptor. The additional variable heavy domain and additional variable light domain form an "extra" central Fv that binds a second receptor. As for many of the embodiments herein, these constructs include skew variants, pI variants, ablation variants, additional Fc variants, etc. as desired and described herein. In this embodiment, suitable Fv pairs include (Fabs listed first, "extra" central Fv second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the central-Fv format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the central-Fv format includes skew variants, pI variants, and ablation variants. Accordingly, some embodiments include central scFv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first receptor; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the second receptor as outlined herein; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the central-Fv format includes skew variants, pI variants, ablation variants and FcRn variants. Accordingly, some embodiments include central-scFv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first receptor and an scFv domain that binds to a second receptor; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein; and c) a light chain comprising a first variable light domain and a constant light domain. In this embodiment, suitable Fv pairs include (Fabs listed first, scFvs second) ICOS X PD-1, PD-1 X ICOS, ICOS X PD-L1, PD-L1 X ICOS, ICOS X CTLA-4 and CTLA-4 X ICOS.

For central-Fv formats suitable Fvs that bind ICOS include, but are not limited to, shown in FIG. 19, FIG. 20, FIG. 24, FIG. 68 and FIG. 77 as well as SEQ ID NO: 27869-28086, 28087-28269, 27193-27335, 28549-28556 and 28557-28665.

For central-Fv formats suitable Fvs that bind PD-L1 include, but are not limited to, those shown in FIG. 15, FIG. 73 and FIG. 78 and SEQ ID NO: 3961-4432.

For central-Fv formats suitable Fvs that bind GITR include, but are not limited to, those in FIG. 18, FIG. 72 and FIG. 73 and those listed in SEQ ID NO:26282-26290.

For central-Fv formats suitable Fvs that bind OX40 include, but are not limited to, FIG. 17, FIG. 72 and FIG. 73 and those listed in SEQ ID NO: 26272-26281.

For central-Fv formats suitable Fvs that bind 4-1BB include, but are not limited to, FIG. 16, FIG. 72 and FIG. 73 and SEQ ID NO: 26262-2671.

For central-FV formats suitable Fvs that bind PD-L1 include, but are not limited to, those of FIG. 15, FIG. 73 and FIG. 78 and SEQ ID NO: 3961-4432.

I. One Armed Central-scFv

One heterodimeric scaffold that finds particular use in the present invention is the one armed central-scFv format shown in FIG. 1C. In this embodiment, one monomer comprises just an Fc domain, while the other monomer includes a Fab domain (a first antigen binding domain), a scFv domain (a second antigen binding domain) and an Fc domain, where the scFv domain is inserted between the Fc domain and the Fc domain. In this format, the Fab portion binds one receptor target and the scFv binds another.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers, in either orientation, VH1-CH1-[optional domain linker]-VH2-scFv linker-VL2-[optional domain linker]-CH2-CH3 or VH1-CH1-[optional domain linker]-VL2-scFv linker-VH2-[optional domain linker]-CH2-CH3. The second monomer comprises an Fc domain (CH2-CH3). This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figure.

In addition, the Fc domains of the one armed central-scFv format generally comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the one armed central-scFv format includes skew variants, pI variants, and ablation variants. Accordingly, some embodiments include formats that comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to a first receptor, and a scFv that binds to the other receptor; b) a second monomer that comprises the skew variants L368D/K370S, the pI variants Q295E/N384D/Q418E/N421D, the ablation variants E233P/L234V/L235A/G236del/S267K, and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the one armed central-scFv format includes skew variants, pI variants, ablation variants and FcRn variants. Accordingly, some embodiments include formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first receptor and a scFv domain that binds to a second receptor; b) a second monomer that comprises the skew variants L368D/K370S, the pI variants Q295E/N384D/Q418E/N421D, the ablation variants E233P/L234V/L235A/G236del/S267K, the FcRn variants M428L/N434S. and c) a light chain comprising a first variable light domain and a constant light domain.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

J. One Armed scFv-mAb

One heterodimeric scaffold that finds particular use in the present invention is the one armed scFv-mAb format shown in FIG. 2D. In this embodiment, one monomer comprises just an Fc domain, while the other monomer uses a scFv domain attached at the N-terminus of the heavy chain, generally through the use of a linker: vh1-scFv linker-vl1-[optional domain linker]-VH2-CH1-hinge-CH2-CH3 or (in the opposite orientation) vl1-scFv linker-vh1-[optional domain linker]-VH2-CH1-hinge-CH2-CH3. In this format, either the Fab portion binds one receptor target and the scFv binds another. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or as shown in the Figures.

In addition, the Fc domains of the comprise skew variants (e.g. a set of amino acid substitutions as shown in FIG. 4, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the one armed scFv-mAb format includes skew variants, pI variants, and ablation variants. Accordingly, some embodiments include formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the one armed scFv-mAb format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

K. scFv-mAb Format

One heterodimeric scaffold that finds particular use in the present invention is the mAb-scFv format shown in FIG. 2E. In this embodiment, the format relies on the use of a N-terminal attachment of a scFv to one of the monomers, thus forming a third antigen binding domain, wherein the Fab portions of the two monomers each bind one target and the "extra" scFv domain binds a different target.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((vh1-scFv linker-vl1-[optional domain linker]-vh2-CH1-hinge-CH2-CH3) or (with the scFv in the opposite orientation) ((vl1-scFv linker-vh1-[optional domain linker]-vh2-CH1-hinge-CH2-CH3)). The second monomer comprises a heavy chain VH2OCH1-hinge-CH2-CH3. This embodiment further utilizes a common light chain comprising a variable light domain and a constant light domain, that associates with the heavy chains to form two identical Fabs that bind one of the target antigens. As for many of the embodiments herein, these constructs include skew variants, pI variants, ablation variants, additional Fc variants, etc. as desired and described herein. In this embodiment, suitable Fv pairs include (Fabs listed first, scFvs second) ICOS X PD-1, ICOS X PD-L1, ICOS X CTLA-4, ICOS X LAG-3, ICOS X TIM-3, ICOS X BTLA, ICOS X TIGIT, TIGIT X ICOS, PD-1 X ICOS, PD-L1 X ICOS, CTLA-4 X ICOS, LAG-3 X ICOS, TIM-3 X ICOS, BTLA X ICOS, OX40 X TIGIT, OX40 X PD-1, OX40 X PD-L1, OX40 X CTLA-4, OX40 X LAG-3, OX40 X TIM-3, OX40 X BTLA, TIGIT X OX40, PD-1 X OX40, PD-L1 X OX40, CTLA-4 X OX40, LAG-3 X OX40, TIM-3 X OX40, BTLA X OX40, GITR X TIGIT, GITR X PD-1, GITR X PD-L1, GITR X CTLA-4, GITR X LAG-3, GITR X TIM-3, GITR X BTLA, TIGIT x GITR, PD-1 X GITR, PD-L1 X GITR, CTLA-4 X GITR, LAG-3 X GITR, TIM-3 X GITR, BTLA X GITR, 4-1BB X TIGIT, 4-1BB X PD-1, 4-1BB X PD-L1, 4-1BB X CTLA-4, 4-1BB X LAG-3, 4-1BB X TIM-3, 4-1BB X BTLA, TIGIT X 4-1BB, PD-1 X 4-1BB, PD-L1 X 4-1BB, CTLA-4 X 4-1BB, LAG-3 X 4-1BB, TIM-3 X 4-1BB and BTLA X 4-1BB.

The ABD sequences for these combinations can be as disclosed in the sequence listing or in the Figures.

In addition, the Fc domains of the scFv-mAb format comprise skew variants (e.g. a set of amino acid substitutions as shown in FIG. 4, with particularly useful skew variants being selected from the group consisting of S364K/ E357Q: L368D/K370S; L368D/K370S: S364K; L368E/ K370S: S364K; T411T/E360E/Q362E: D401K; L368D/ K370S: S364K/E357L, K370S: S364K/E357Q, T366S/ L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the mAb-scFv format includes skew variants, pI variants, and ablation variants. Accordingly, some embodiments include bottle opener formats that comprise: a) a first monomer that comprises the skew variants S364K/E357Q, the ablation variants E233P/L234V/ L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In some embodiments, the mAb-scFv format includes skew variants, pI variants, ablation variants and FcRn variants. Accordingly, some embodiments include bottle opener formats that comprise: a) a first monomer that comprises the skew variants S364K/E357Q, the ablation variants E233P/ L234V/L235A/G236del/S267K, the FcRn variants M428L/ N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/ Q295E/N384D/Q418E/N421D, the ablation variants E233P/ L234V/L235A/G236del/S267K, the FcRn variants M428L/ N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

L. Dual scFv Formats

The present invention also provides dual scFv formats as are known in the art and shown in FIG. 2B. In this embodiment, the heterodimeric bispecific antibody is made up of two scFv-Fc monomers (both in either (vh-scFv linker-vl-[optional domain linker]-CH2-CH3) format or (vl-scFv linker-vh-[optional domain linker]-CH2-CH3) format, or with one monomer in one orientation and the other in the other orientation.

In this case, all ABDs are in the scFv format, with any combination of ICOS and PD-1, ICOS and CTLA-4, ICOS and LAG-3, ICOS and TIM-3, ICOS and PD-L1, ICOS and BTLA, GITR and PD-1, GITR and CTLA-4, GITR and LAG-3, GITR and TIM-3, GITR and PD-L1, GITR and BTLA, OX40 and PD-1, OX40 and CTLA-4, OX40 and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1 and 4-1BB and BTLA being useful. The ABD sequences for these combinations can be as disclosed in the sequence listing or as shown in the Figures.

In addition, the Fc domains of the dual scFv format comprise skew variants (e.g. a set of amino acid substitutions as shown in FIG. 4, with particularly useful skew variants being selected from the group consisting of S364K/ E357Q: L368D/K370S; L368D/K370S: S364K; L368E/ K370S: S364K; T411T/E360E/Q362E: D401K; L368D/ K370S: S364K/E357L, K370S: S364K/E357Q, T366S/ L368A/Y407V: T366W and T366S/L368A/Y407V/Y349C: T366W/S354C), optionally ablation variants (including those shown in FIG. 6), optionally charged scFv linkers (including those shown in FIG. 8) and the heavy chain comprises pI variants (including those shown in FIG. 5).

In some embodiments, the dual scFv format includes skew variants, pI variants, and ablation variants. Accordingly, some embodiments include formats that comprise: a) a first monomer that comprises the skew variants S364K/ E357Q, the ablation variants E233P/L234V/L235A/ G236del/S267K, and a scFv that binds a first receptor (VH1-scFv linker-VL1-[optional domain linker]-CH2-CH3 or VL1-scFv linker-VH1-[optional domain linker]-CH2-CH3) and b) a first monomer that comprises the skew variants L368D/K370S, the ablation variants E233P/L234V/L235A/G236del/S267K, and a scFv that binds a first receptor (VH1-scFv linker-VL1-[optional domain linker]-CH2-CH3 or VL1-scFv linker-VH1-[optional domain linker]-CH2-CH3). pI variants can be as outlined herein, but most common will be charged scFv linkers of opposite charge for each monomer. FcRn variants, particularly 428L/434S, can optionally be included. In some particular embodiments with these variants in this format:

(1) the format comprises a ABD binds to ICOS that has the ABD of [ICOS] H0.66_L0;

(2) the format comprises an ICOS ABD of H0.66_L0 combined with the ABD comprising the ABD 1G6_L1.194_H1.279 that binds to PD-1;

(3) the format comprises an ICOS ABD of H0.66_L0 combined with the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises the ABD 1G6_L1.194_H1.279 that binds to PD-1 and an Fv binds to GITR;

(6) the format comprises the ABD 1G6_L1.194_H1.279 that binds to PD-1 and the Fv binds to OX40;

(7) the format comprises the ABD 1G6_L1.194_H1.279 that binds to PD-1 and the ABD binds to ICOS;

8) the format comprises the ABD 1G6_L1.194_H1.279 that binds to PD-1 and an ABD binds to 4-1BB; and (9) the format comprises the ABD of H0.66_L0 that binds to ICOS and an ABD that binds to PD-L1.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

M. Non-Heterodimeric Bispecific Antibodies

As will be appreciated by those in the art, the Fv sequences outlined herein can also be used in both monospecific antibodies (e.g. "traditional monoclonal antibodies") or non-heterodimeric bispecific formats (see FIGS. 2J, K and L).

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

Suitable non-heterodimeric bispecific formats are known in the art, and include a number of different formats as generally depicted in Spiess et al., Molecular Immunology (67):95-106 (2015) and Kontermann, mAbs 4:2, 182-197 (2012), both of which are expressly incorporated by reference and in particular for the figures, legends and citations to the formats therein.

N. DVD-Ig Format

In some embodiments, the bispecific antibody is in a "Dual Variable Domain-Ig" or "DVD-Ig™" format (see FIG. 2L) such as is generally described in U.S. Pat. No. 7,612,181, hereby expressly incorporated by reference in its entirety, and in particular for the Figures and Legends therein. In the DVD-Ig format, the antibody is tetravalent and bispecific, and comprises 4 chains: two homodimeric heavy chains and two identical light chains. The heavy chains each have a VH1-(optional linker)-VH2-CH1-hinge-CH2-CH3 structure and the two light chains each have a VL1-optional linker-VL2-CL structure, with VH1 and VL1 forming a first ABD and the VH2 and VL2 forming a second ABD, where the first and second ABDs bind a costimulatory and a checkpoint receptor. In this embodiment, suitable combinations include ICOS and PD-1, ICOS and CTLA-4, ICOS and LAG-3, ICOS and TIM-3, ICOS and PD-L1, ICOS and BTLA, GITR and PD-1, GITR and CTLA-4, GITR and LAG-3, GITR and TIM-3, GITR and PD-L1, GITR and BTLA, OX40 and PD-1, OX40 and CTLA-4, OX40 and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1 and 4-1BB and BTLA.

The DVD-Ig™ and Central-scFv2 are two formats that are bispecific and tetravalent, and thus do not bind a costimulatory receptor in a monovalent fashion. Exemplary DVD-Ig™ constructs are shown in FIG. 61.

In some particular embodiments with these variants in this format:

(1) the format comprises the ABD of [ICOS] H0.66_L0;

(2) the format comprises an ICOS ABD of H0.66_L0 combined with the ABD comprising the ABD 1G6_L1.194_H1.279 that binds to PD-1;

(3) the format comprises an ICOS ABD of H0.66_L0 combined with the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises the ABD 1G6_L1.194_H1.279 that binds to PD-1 and an ABD that binds to GITR;

(6) the format comprises the ABD 1G6_L1.194_H1.279 that binds to PD-1 and ABD that binds to OX40;

(7) the format comprises the ABD 1G6_L1.194_H1.279 that binds to PD-1 and an ABD that binds to ICOS;

8) the format comprises the ABD 1G6_L1.194_H1.279 that binds to PD-1 and an ABD that binds to 4-1BB; and (9) the format comprises the ABD of H0.66_L0 that binds to ICOS and an ABD that binds to PD-L1.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

O. Trident Format

In some embodiments, the bispecific antibodies of the invention are in the "Trident" format as generally described in WO2015/184203, hereby expressly incorporated by reference in its entirety and in particular for the Figures, Legends, definitions and sequences of "Heterodimer-Promoting Domains" or "HPDs", including "K-coil" and "E-coil" sequences. Tridents rely on using two different HPDs that associate to form a heterodimeric structure as a component of the structure, see FIG. 2M. In this embodiment, the Trident format include a "traditional" heavy and light chain (e.g. VH1-CH1-hinge-CH2-CH3 and VL1-CL), a third chain comprising a first "diabody-type binding domain" or "DART®", VH2-(linker)-VL3-HPD1 and a fourth chain comprising a second DART®, VH3-(linker)-(linker)-VL2-HPD2. The VH1 and VL1 form a first ABD, the VH2 and VL2 form a second ABD, and the VH3 and VL3 form a third ABD. IN some cases, as is shown in FIG. 2M, the second and third ABDs bind the same antigen, in this instance generally the checkpoint receptor, e.g. bivalently, with the first ABD binding a costimulatory receptor monovalently. In this embodiment, suitable combinations include ICOS and PD-1, ICOS and CTLA-4, ICOS and LAG-3, ICOS and TIM-3, ICOS and PD-L1, ICOS and BTLA, GITR and PD-1, GITR and CTLA-4, GITR and LAG-3, GITR and TIM-3, GITR and PD-L1, GITR and BTLA, OX40 and PD-1, OX40 and CTLA-4, OX40 and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1 and 4-1BB and BTLA.

In some particular embodiments with these variants in this format:

(1) the format comprises a Fab ABD binds to ICOS that has the ABD of [ICOS] H0.66_L0;

(2) the format comprises an ICOS ABD of H0.66_L0 combined with the scFv ABD comprising the ABD 1G6_L1.194_H1.279 that binds to PD-1;

(3) the format comprises an ICOS ABD of H0.66_L0 combined with the scFv comprising the ABD H3.23_L0.129 that binds to CTLA-4;

(4) the format comprises an ICOS ABD of H0.66_L0 is combined with the ABD 7G8_H.303_L1.34 that binds to LAG-3;

(5) the format comprises a scFv comprising the ABD 1G6_L1.194_H1.279 that binds to PD-1 and the Fab binds to GITR;

(6) the format comprises a scFv comprising the ABD 1G6_L1.194_H1.279 that binds to PD-1 and the Fab binds to OX40;

(7) the format comprises a scFv comprising the ABD 1G6_L1.194_H1.279 that binds to PD-1 and the Fab binds to ICOS;

8) the format comprises a scFv comprising the ABD 1G6_L1.194_H1.279 that binds to PD-1 and the Fab binds to 4-1BB; and (9) the format comprises the ABD of H0.66_L0 that binds to ICOS and an ABD that binds to PD-L1.

In this format, specific ABDs that bind human ICOS include, but are not limited to, [ICOS]_H0L0 and [ICOS] H0.66_L0 and those shown in FIG. 19, FIG. 20, FIG. 24, FIG. 68 and FIG. 77 as well as SEQ ID NO: 27869-28086, 28087-28269, 27193-27335, 28549-28556 and 28557-28665.

In this format, specific ABDs that bind human GITR include, but are not limited to, those in FIG. 18, FIG. 72 and FIG. 73 and those listed in SEQ ID NO:26282-26290.

In this format, specific ABDs that bind OX40 include, but are not limited to, FIG. 17, FIG. 72 and FIG. 73 and those listed in SEQ ID NO: 26272-26281.

In this format, specific ABDs that bind human 4-1BB include, but are not limited to, FIG. 16, FIG. 72 and FIG. 73 and SEQ ID NO: 26262-2671.

In this format, specific ABDs that bind human PD-L1 include, but are not limited to, FIG. 15, FIG. 73 and FIG. 78 and SEQ ID NO: 3961-4432.

P. Monospecific, Monoclonal Antibodies

As will be appreciated by those in the art, the novel Fv sequences outlined herein can also be used in both monospecific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

VIII. Antigen Binding Domains (ABDs) to Target Antigens

The bispecific antibodies of the invention have two different antigen binding domains (ABDs) that bind to two different target receptor antigens ("target pairs"), in either bivalent, bispecific formats or trivalent, bispecific formats as generally shown in FIG. 2.

The bispecific antibodies bind to a first target antigen comprising a checkpoint receptor and a second target antigen comprising a costimulatory receptor. Suitable checkpoint receptors as outlined herein include PD-1, PD-L1, LAG-3, TIM-3, CTLA-4, BTLA and TIGIT. Suitable costimulatory receptors as outlined herein include ICOS, GITR, OX40 and 4-1BB. As outlined Suitable target checkpoint antigens include human (and sometimes cyno) PD-1, CTLA-4, TIM-3, LAG-3, TIGIT and BTLA (sequences in the sequence listing). Accordingly, suitable bispecific antibodies bind ICOS and PD-1, ICOS and CTLA-4, ICOS and LAG-3, ICOS and TIM-3, ICOS and PD-L1, ICOS and BTLA, ICOS and TIGIT, GITR and TIGIT, GITR and PD-1, GITR and CTLA-4, GITR and LAG-3, GITR and TIM-3, GITR and PD-L1, GITR and BTLA, OX40 and PD-1, OX40 and TIGIT, OX40 and CTLA-4, IC OX40 OS and LAG-3, OX40 and TIM-3, OX40 and PD-L1, OX40 and BTLA, 4-1BB and PD-1, 4-1BB and CTLA-4, 4-1BB and LAG-3, 4-1BB and TIM-3, 4-1BB and PD-L1, TIGIT and 4-1BB and 4-1BB and BTLA.

Note that generally these bispecific antibodies are named "anti-PD-1 X anti-CTLA-4", or generally simplistically or for ease (and thus interchangeably) as "PD-1 X CTLA-4", etc. for each pair. Note that unless specified herein, the order of the antigen list in the name does not confer structure; that is a PD-1 X CTLA-4 bottle opener antibody can have the scFv bind to PD-1 or CTLA-4, although in some cases, the order specifies structure as indicated.

As is more fully outlined herein, these combinations of ABDs can be in a variety of formats, as outlined below, generally in combinations where one ABD is in a Fab format and the other is in an scFv format. As discussed herein and shown in FIG. 2, some formats use a single Fab and a single scFv (A, C and D), and some formats use two Fabs and a single scFv (E, F, G, H and I).

A. Antigen Binding Domains

As discussed herein, the bispecific checkpoint heterodimeric antibodies of the invention include two antigen binding domains (ABDs), each of which bind to a different checkpoint protein. As outlined herein, these heterodimeric antibodies can be bispecific and bivalent (each antigen is bound by a single ABD, for example, in the format depicted in FIG. 2A), bispecific and trivalent (one antigen is bound by a single ABD and the other is bound by two ABDs, for example as depicted in FIG. 2F, G, H, I or M), or bispecific and tetravalent (both antigens are bound by two ABDs, for example as depicted in FIGS. 2J and L).

In addition, in general, one of the ABDs comprises a scFv as outlined herein, in an orientation from N- to C-terminus of vh-scFv linker-vl or vl-scFv linker-vh. One or both of the other ABDs, according to the format, generally is a Fab, comprising a vh domain on one protein chain (generally as a component of a heavy chain) and a vl on another protein chain (generally as a component of a light chain). Note that the "trident" format uses DART®s, which are similar to scFvs except the orientation is different and in general the linkers can be slightly longer.

The invention provides a number of ABDs that bind to a number of different receptor proteins, as outlined below. As will be appreciated by those in the art, any set of 6 CDRs or vh and vl domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 8.

In addition, as discussed above, the numbering used in the Sequence Listing for the identification of the CDRs is Kabat, however, different numbering can be used, which will change the amino acid sequences of the CDRs as shown in Table 1.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

B. PD-1 Antigen Binding Domains

In some embodiments, one of the ABDs binds PD-1. Suitable sets of 6 CDRs and/or vh and vl domains, as well as scFv sequences, are depicted in FIG. 3, FIG. 10, FIG. 11, FIG. 72, FIG. 73, FIG. 74, FIG. 76 and SEQ ID NO:1-2392, 3125-3144, 4697-7594 and 4697-21810, and include those sequences in the sequence listing with the identifiers 1G6_H1.279_L1.194; 1G6_H1.280_L1.224; 1G6_L1.194_H1.279; 1G6_L1.210_H1.288; and 2E9_H1L1.

As will be appreciated by those in the art, suitable anti-PD-1 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of these sequences. Suitable ABDs can also include the entire vh and vl sequences as depicted in these sequences and Figures, used as scFvs or as Fabs. In many of the embodiments herein that contain an Fv to PD-1, it is the scFv monomer that binds PD-1. As discussed herein, the other of the target pair when PD-1 is one of the antigens is selected from ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665 (which can be scFv sequences, CDR sequence sets or vh and vl sequences)), GITR, OX40 and 4-1BB.

Particularly useful ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1.

Additionally useful vh and vl sequences that bind human PD-1 are shown in FIG. 76.

In addition to the parental CDR sets disclosed in the sequence listing that form an ABD to PD-1, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to PD-1, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

Specific preferred embodiments include the 1G6_L1.194_H1.279 anti-PD-1 Fv, in a scFv format, included within any of the bottle opener format backbones of FIG. 9.

Specific preferred embodiments include the 1G6_L1.194_H1.279 anti-PD-1 Fv, in a scFv format, included within any of the format backbones of FIGS. 55A-55D.

Specific preferred embodiments include the 1G6_L1.194_H1.279 anti-PD-1 Fv, in a scFv format, included within any of the mAb-scFv format backbones of FIG. 75.

Other embodiments utilize any of the anti-PD-1 vh and vl domain pairs (either as scFvs or Fabs) as shown in FIG. 76 in any format shown in FIG. 2.

C. CTLA-4 Antigen Binding Domains

In some embodiments, one of the ABDs binds CTLA-4. Suitable sets of 6 CDRs and/or vh and vl domains, as well as scFv sequences, are depicted in SEQ ID NOs: 2393-2414 and 3737-3816, as well as sequences of particular interest in some embodiments are shown in FIG. 12 and FIG. 79 and also include those sequences in the sequence listing with the identifiers [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67; and [CTLA-4]_H3_L0.74.

As will be appreciated by those in the art, suitable anti-CTLA-4 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences outlined herein. Suitable ABDs can also include the entire vh and vl sequences as depicted in these sequences and Figures, used as scFvs or as Fabs. In many of the embodiments herein that contain an Fv to CTLA-4, it is the scFv monomer that binds CTLA-4.

As discussed herein, the other of the target pair when CTLA-4 is one of the antigens is selected from ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

In addition to the parental CDR sets disclosed in the sequence listing that form an ABD to CTLA-4, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to CTLA-4, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

D. TIM-3 Antigen Binding Domains

In some embodiments, one of the ABDs binds TIM-3. Suitable sets of 6 CDRs and/or vh and vl domains, as well as scFv sequences, are depicted in FIG. 14 and FIG. 81 and SEQ ID NO: 3345-3704, 4585-4696. ABD sequences of particular interest in some embodiments include those sequences in the sequence listing with the identifiers 1D10_H0L0; 1D12_H0L0; 3H3_H1_L2.1; 6C8_H0L0; 6D9_H0_1D12_L0; 7A9_H0L0; 7B11_H0L0; 7B11var_H0L0; and 7C2_H0L0.

As will be appreciated by those in the art, suitable anti-TIM-3 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of those depicted herein. Suitable ABDs can also include the entire vh and vl sequences as depicted in these sequences and Figures, used as scFvs or as Fabs. In many of the embodiments herein that contain an Fv to TIM-3, it is the Fab monomer that binds TIM-3. As discussed herein, the other of the target pair when TIM-3 is one of the antigens is selected ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

In addition to the parental CDR sets disclosed in the sequence listing that form an ABD to TIM-3, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to TIM-3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

LAG-3 Antigen Binding Domains

In some embodiments, one of the ABDs binds LAG-3. Suitable sets of 6 CDRs and/or vh and vl domains, as well as scFv sequences, are depicted in FIG. 13, FIG. 80 and in SEQ ID NO: 2415-2604, 3817-3960 also include those sequences in the sequence listing with the identifiers 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1, 7G8_H3.18_L1.11, 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1.

As will be appreciated by those in the art, suitable anti-LAG-3 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of the sequences herein. Suitable ABDs can also include the entire vh and vl sequences as depicted in these sequences and Figures, used as scFvs or as Fabs. In many of the embodiments herein that contain an Fv to LAG-3, it is the Fab monomer that binds LAG-3. As discussed herein, the other of the target pair when LAG-3 is one of the antigens is selected from ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

In addition to the parental CDR sets disclosed in the sequence listing that form an ABD to LAG-3, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to LAG-3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

E. BTLA Antigen Binding Domains

In some embodiments, one of the ABDs binds BTLA. Suitable sets of 6 CDRs and/or vh and vl domains, as well as scFv sequences, are depicted in FIG. 82, FIG. 84 and SEQ ID NO:3705-3736, and also include those sequences in the sequence listing with the identifiers 9C6_H0L0; 9C6_H1.1_L1; and 9C6_H1.11_L1.

As will be appreciated by those in the art, suitable anti-BTLA ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences depicted herein. Suitable ABDs can also include the entire vh and vl sequences as depicted in these sequences and Figures, used as scFvs or as Fabs. In many of the embodiments herein that contain an Fv to BTLA, it is the Fab monomer that binds BTLA. As discussed herein, the other of the target pair when BTLA is one of the antigens is selected from ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

In addition to the parental CDR sets disclosed in the sequence listing that form an ABD to BTLA, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to BTLA, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon

F. TIGIT Antigen Binding Domains

In some embodiments, one of the ABDs binds TIGIT. Suitable sets of 6 CDRs and/or vh and vl domains, as well as scFv sequences, are depicted in FIG. 8? And in SEQ ID NO:4433-4585.

As will be appreciated by those in the art, suitable anti-TIGIT ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences depicted herein. Suitable ABDs can also include the entire vh and vl sequences as depicted in these sequences and Figures, used as scFvs or as Fabs. In many of the embodiments herein that contain an Fv to TIGIT, it is the Fab monomer that binds TIGIT. As discussed herein, the other of the target pair when TIGIT is one of the antigens is selected ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

G. PD-L1 Antigen Binding Domains

In some embodiments, one of the ABDs binds PD-L1. Suitable sets of 6 CDRs and/or vh and vl domains, as well as scFv sequences, are depicted in FIG. 15, FIG. 73 and FIG. 78, and in SEQ ID NO:3961-4432.

As will be appreciated by those in the art, suitable anti-TIGIT ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences depicted herein. Suitable ABDs can also include the entire vh and vl sequences as depicted in these sequences and Figures, used as scFvs or as Fabs. In many of the embodiments herein that contain an Fv to TIGIT, it is the Fab monomer that binds TIGIT. As discussed herein, the other of the target pair when TIGIT is one of the antigens is selected ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0), GITR, OX40 and 4-1BB.

H. ICOS Antigen Binding Domains

In some embodiments, one of the ABDs binds ICOS. Suitable sets of 6 CDRs and/or vh and vl domains, as well as scFv sequences ICOS (suitable sequences are shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

As will be appreciated by those in the art, suitable anti-ICOS ABDs can comprise a set of 6 CDRs as depicted in these sequences and Figures, either as they are underlined or, in the case where a different numbering scheme is used as described herein and as shown in Table 1, as the CDRs that are identified using other alignments within the sequences disclosed herein. Suitable ABDs can also include the entire vh and vl sequences as depicted in these sequences and Figures, used as scFvs or as Fabs. In many of the embodiments herein that contain an Fv to ICOS, it is the Fab monomer that binds ICOS. As discussed herein, the other of the target pair when ICOS is one of the antigens is selected from PD-1 are depicted in FIG. 3, FIG. 10, FIG. 11, FIG. 72, FIG. 73, FIG. 74, FIG. 76 and SEQ ID NO:1-2392, 3125-3144, 4697-7594 and 4697-21810, and include those sequences in the sequence listing with the identifiers 1G6_H1.279_L1.194; 1G6_H1.280_L1.224; 1G6_L1.194_H1.279; 1G6_L1.210_H1.288; and 2E9_H1L1 (which can be scFv sequences, CDR sequence sets or vh and vl sequences)), CTLA-4 (suitable sequences are depicted in FIGS. 12, 72 and 79, as well as SEQ ID NO:2393-2414 and 3737-3816 (which can be scFv sequences, CDR sequence sets or vh and vl sequences)), TIM-3 (suitable sequences are depicted in FIG. 14, FIG. 81 and SEQ ID NO: 3345-3704, 4585-4696 (which can be scFv sequences, CDR sequence sets or vh and vl sequences)), LAG-3 (suitable sequences are depicted in FIG. 13, FIG. 80 and SEQ ID NO:2415-2604, 3817-3960 (which can be scFv sequences, CDR sequence sets or vh and vl sequences)), BTLA (suitable sequences are depicted in FIGS. 82 and 84 and SEQ ID NO?3705-3736 (which can be scFv sequences, CDR sequence sets or vh and vl sequences)), and TIGIT (suitable sequences are depicted in Figure XX and SEQ ID NO:4433-4585 (which can be scFv sequences, CDR sequence sets or vh and vl sequences)).

In addition to the parental CDR sets disclosed in the sequence listing that form an ABD to ICOS, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to ICOS, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

Specific preferred embodiments include the [ICOS]_H0.66_L0 anti-ICOS Fv, in a Fab format, included within any of the bottle opener format backbones of FIG. 9.

Specific preferred embodiments include the [ICOS]_H0_L0 anti-ICOS Fv, in a scFv format, included within any of the bottle opener format backbones of FIG. 9.

Specific preferred embodiments include the [ICOS]_H0.66_L0 anti-ICOS Fv, in a scFv format, included within any of the mAb-scFv format backbones of FIG. 75.

Specific preferred embodiments include the [ICOS]_H0.66_L0 anti-ICOS Fv, in a Fab format, included within any of the mAb-scFv format backbones of FIG. 75.

Specific preferred embodiments include the [ICOS]_H0.66_L0 anti-ICOS Fv, in a Fab format, included within any of the format backbones of FIGS. 55A-55D.

I. GITR Antigen Binding Domains

In some embodiments, one of the ABDs binds GITR. Suitable sets of 6 CDRs and/or vh and vl domains, as well as scFv sequences FITR (suitable sequences are shown in FIG. 18, FIG. 72 and FIG. 73, and in SEQ ID NO: 26282-26290.

As will be appreciated by those in the art, suitable anti-GITR ABDs can comprise a set of 6 CDRs as depicted in these sequences and Figures, either as they are underlined or, in the case where a different numbering scheme is used as described herein and as shown in Table 1, as the CDRs that are identified using other alignments within the sequences disclosed herein. Suitable ABDs can also include the entire vh and vl sequences as depicted in these sequences and Figures, used as scFvs or as Fabs. In many of the embodiments herein that contain an Fv to GITR, it is the Fab monomer that binds GITR. As discussed herein, the other of the target pair when GITR is one of the antigens is selected from PD-1 are depicted in FIG. 3, FIG. 10, FIG. 11, FIG. 72, FIG. 73, FIG. 74, FIG. 76 and SEQ ID NO:1-2392, 3125-3144, 4697-7594 and 4697-21810, and include those sequences in the sequence listing with the identifiers 1G6_H1.279_L1.194; 1G6_H1.280_L1.224; 1G6_L1.194_H1.279; 1G6_L1.210_H1.288; and 2E9_H1L1 (which can be scFv sequences, CDR sequence sets or vh and vl sequences)), CTLA-4 (suitable sequences are depicted in FIGS. 12, 72 and 79, as well as SEQ ID NO:2393-2414 and 3737-3816 (which can be scFv sequences, CDR sequence sets or vh and vl sequences)), TIM-3 (suitable sequences are depicted in FIG. 14, FIG. 81 and SEQ ID NO: 3345-3704, 4585-4696 (which can be scFv sequences, CDR sequence sets or vh and vl sequences)), LAG-3 (suitable sequences are depicted in FIG. 13, FIG. 80 and SEQ ID NO:2415-2604, 3817-3960 (which can be scFv sequences, CDR sequence sets or vh and vl sequences)), BTLA (suitable sequences are depicted in FIGS. 82 and 84 and SEQ ID NO?3705-3736 (which can be scFv sequences, CDR sequence sets or vh and vl sequences)), and TIGIT (suitable sequences are depicted in Figure XX and SEQ ID NO:4433-4585 (which can be scFv sequences, CDR sequence sets or vh and vl sequences)).

In addition to the parental CDR sets disclosed in the sequence listing that form an ABD to GITR, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to GITR, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

J. OX40 Antigen Binding Domains

In some embodiments, one of the ABDs binds OX40. Suitable sets of 6 CDRs and/or vh and vl domains, as well as scFv sequences for OX40 are provided (suitable sequences are shown in FIG. 17, FIG. 72 and FIG. 73, and in SEQ ID NO: 26272-26281.

As will be appreciated by those in the art, suitable anti-OX40 ABDs can comprise a set of 6 CDRs as depicted in these sequences and Figures, either as they are underlined or, in the case where a different numbering scheme is used as described herein and as shown in Table 1, as the CDRs that are identified using other alignments within the sequences disclosed herein. Suitable ABDs can also include the entire vh and vl sequences as depicted in these sequences and Figures, used as scFvs or as Fabs. In many of the embodiments herein that contain an Fv to OX40, it is the Fab monomer that binds GITR. As discussed herein, the other of the target pair when OX40 is one of the antigens is selected from PD-1 are depicted in FIG. 3, FIG. 10, FIG. 11, FIG. 72, FIG. 73, FIG. 74, FIG. 76 and SEQ ID NO:1-2392, 3125-3144, 4697-7594 and 4697-21810, and include those sequences in the sequence listing with the identifiers 1G6_H1.279_L1.194; 1G6_H1.280_L1.224; 1G6_L1.194_H1.279; 1G6_L1.210_H1.288; and 2E9_H1L1 (which can be scFv sequences, CDR sequence sets or vh and vl sequences)), CTLA-4 (suitable sequences are depicted in FIGS. 12, 72 and 79, as well as SEQ ID NO:2393-2414 and 3737-3816 (which can be scFv sequences, CDR sequence sets or vh and vl sequences)), TIM-3 (suitable sequences are depicted in FIG. 14, FIG. 81 and SEQ ID NO: 3345-3704, 4585-4696 (which can be scFv sequences, CDR sequence sets or vh and vl sequences)), LAG-3 (suitable sequences are depicted in FIG. 13, FIG. 80 and SEQ ID NO:2415-2604, 3817-3960 (which can be scFv sequences, CDR sequence sets or vh and vl sequences)), BTLA (suitable sequences are depicted in FIGS. 82 and 84 and SEQ ID NO?3705-3736 (which can be scFv sequences, CDR sequence sets or vh and vl sequences)), and TIGIT (suitable sequences are depicted in Figure XX and SEQ ID NO:4433-4585 (which can be scFv sequences, CDR sequence sets or vh and vl sequences)).

In addition to the parental CDR sets disclosed in the sequence listing that form an ABD to OX40, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to OX40, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

K. 4-1BB Antigen Binding Domains

In some embodiments, one of the ABDs binds 4-1BB. Suitable sets of 6 CDRs and/or vh and vl domains, as well as scFv sequences 4-1BB (suitable sequences are shown in FIG. 16, FIG. 72 and FIG. 73, and in SEQ ID NO:26262-2671.

As will be appreciated by those in the art, suitable anti-4-1BB ABDs can comprise a set of 6 CDRs as depicted in these sequences and Figures, either as they are underlined or, in the case where a different numbering scheme is used as described herein and as shown in Table 1, as the CDRs that are identified using other alignments within the sequences disclosed herein. Suitable ABDs can also include the entire vh and vl sequences as depicted in these sequences and Figures, used as scFvs or as Fabs. In many of the embodiments herein that contain an Fv to 4-1BB, it is the Fab monomer that binds 4-1BB. As discussed herein, the other of the target pair when ICOS is one of the antigens is selected from PD-1 are depicted in FIG. 3, FIG. 10, FIG. 11, FIG. 72, FIG. 73, FIG. 74, FIG. 76 and SEQ ID NO:1-2392, 3125-3144, 4697-7594 and 4697-21810, and include those sequences in the sequence listing with the identifiers 1G6_H1.279_L1.194; 1G6_H1.280_L1.224; 1G6_L1.194_H1.279; 1G6_L1.210_H1.288; and 2E9_H1L1 (which can be scFv sequences, CDR sequence sets or vh and vl sequences)), CTLA-4 (suitable sequences are depicted in FIGS. 12, 72 and 79, as well as SEQ ID NO:2393-2414 and 3737-3816 (which can be scFv sequences, CDR sequence sets or vh and vl sequences)), TIM-3 (suitable sequences are depicted in FIG. 14, FIG. 81 and SEQ ID NO: 3345-3704, 4585-4696 (which can be scFv sequences, CDR sequence sets or vh and vl sequences)), LAG-3 (suitable sequences are depicted in FIG. 13, FIG. 80 and SEQ ID NO:2415-2604, 3817-3960 (which can be scFv sequences, CDR sequence sets or vh and vl sequences)), BTLA (suitable sequences are depicted in FIGS. 82 and 84 and SEQ ID NO?3705-3736 (which can be scFv sequences, CDR sequence sets or vh and vl sequences)), and TIGIT (suitable sequences are depicted in Figure XX and SEQ ID NO:4433-4585 (which can be scFv sequences, CDR sequence sets or vh and vl sequences)).

In addition to the parental CDR sets disclosed in the sequence listing that form an ABD to 4-1BB, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to 4-1BB, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

L. Specific Bispecific Embodiments

The invention provides a number of particular bispecific antibodies as outlined below.

1. ICOS X PD-1

The invention provides bispecific heterodimeric antibodies that bind ICOS and PD-1 each monovalently, and in some cases as outlined herein, both bivalently.

In one embodiment, the PD-1 ABD is 1G6_L1.194_H1.279 and the ICOS ABD is selected from sequences shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

In one embodiment, the ICOS X PD-1 bispecific antibody is selected from XENP numbers 20261, 20730, 20896, 22432-22438, 22731-22748, 22878-22894, 22931-22932, 22950-22961, 23090-23093, 23295-23296, 23301, 23405, 23408, 23410 (all without 428L/4345, although they can have those substitutions); XENP numbers 22730, 22917-22928, 22935-22937, 22974-22979, 22995-22996, 23001, 23103, 23104 (all with 428L/4345, although they can not have those); XENP numbers 23411, 21828, 21829, 21830, 21831, 22348, 23059 (using prior art ICOS sequences); XENP numbers 18920, 24125, 24130 (additional bottle openers); XENP 23406, 23407, 24128 (ICOS x PD-1 central-scFv), XENP24123 (ICOS x PD-1 central-scFv2); XENP24134 (ICOS x PD-1 bispecific mAb) 24122 (ICOS x PD-1 DVD-Ig), XENP 24132, 24133 (ICOS x PD-1 Trident).

2. ICOS X PD-L1

In this embodiment, the ICOS ABD is selected from sequences shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

3. ICOS X CTLA-4

In this embodiment, the ICOS ABD is selected from sequences shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

In one embodiment, a bottle opener format with a Fab ICOS ABD of [ICOS]H0.66_L0 is paired with a scFv CTLA-4 ABD of [CTLA-4]_H3.32_L0.129, particularly in bottle opener backbone 1 from FIG. 9.

4. ICOS X LAG-3

In this embodiment, the ICOS ABD is selected from sequences shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

5. ICOS X TIM-3

I this embodiment, the ICOS ABD is selected from sequences shown in FIG. 19, FIG. 20, FIG. 24, FIG. 68 and FIG. 77 as well as SEQ ID NO: 27869-28086, 28087-28269, 27193-27335, 28549-28556 and 28557-28665, and those with the identifiers [ICOS]_H0.66_L0 and [ICOS]_H0L0.

M. Homologous Antibodies

The invention further provides antibodies that share amino acid sequence identity with the antibodies outlined herein.

In one embodiment, bispecific antibodies are made that have amino acid variants in one or more of the CDRs of the Vh and V1 sequences outlined herein and in the Figures. In one embodiment, antibodies are provided that have 1, 2, 3, 4 or 5 amino acid differences in one or more of the CDRs of the vh and vl chains outlined herein. These amino acid variants can be in one CDR or spread out between more than one CDR. These amino acid variants can also be in one or both of the Fvs of the bispecific antibody; e.g. there can be 2 amino acid variants in CDRs on the ICOS Fv side (generally a Fab but can be a scFv as outlined herein) and one on the PD-1 side, etc.

Similarly, the invention provides for antibodies that have at least 95, 96, 97 98 or 99% amino acid identity to the sequences outlined herein, and particularly in the variable heavy and/or variable light domains. This sequence identity can also be on one Fv or both Fv of the bispecific antibodies. That is, bispecific antibodies are provided that are 95-99% identical to the variable heavy and/or variable light domains outlined in the figures.

IX. Nucleic Acids of the Invention

The invention further provides nucleic acid compositions encoding the bispecific antibodies of the invention (or, in the case of "monospecific" antibodies, nucleic acids encoding those as well).

As will be appreciated by those in the art, the nucleic acid compositions will depend on the format and scaffold of the heterodimeric protein. Thus, for example, when the format requires three amino acid sequences, three nucleic acid sequences can be incorporated into one or more expression vectors for expression. Similarly, some formats (e.g. dual scFv formats such as disclosed in FIG. 2) only two nucleic acids are needed; again, they can be put into one or two expression vectors. Some formats need 4 amino acids (bispecific mAbs).

As is known in the art, the nucleic acids encoding the components of the invention can be incorporated into expression vectors as is known in the art, and depending on the host cells used to produce the heterodimeric antibodies of the invention. Generally, the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

X. Biological and Biochemical Functionality of the Heterodimeric Immunomodulatory Antibodies Generally the bispecific immunomodulatory antibodies of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and 3H-Thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs.

Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFN$\gamma$, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFN$\gamma$ and TNF), and cell surface receptor expression (e.g. CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

XI. Treatments

Once made, the compositions of the invention find use in a number of oncology applications, by treating cancer, generally by inhibiting the suppression of T cell activation (e.g. T cells are no longer suppressed) with the binding of the bispecific immunomodulatory antibodies of the invention.

Accordingly, the heterodimeric compositions of the invention find use in the treatment of these cancers.

XII. Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

Administrative Modalities

The antibodies and chemotherapeutic agents of the invention are administered to a subject, in accord with known methods, such as intravenous administration as a bolus or by continuous infusion over a period of time.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

XIII. Examples

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

A. Example 1: TILs from Multiple Cancer Types Co-Express PD-1 and T Cell Costimulatory Receptors To investigate potential associations between PD-1 and various T cell costimulatory receptors, RNA sequencing data from The Cancer Genome Atlas project (TCGA) were used for analysis. V2 RSEM data were downloaded from FireBrowse (http://firebrowse.org/). Analysis was performed using R with custom routines. The correlation between the expression of PD-1 and eight costimulatory receptors is depicted in FIG. 1, along with calculated R2 values (square of the Pearson correlation coefficient). The data show that PD-1 and several costimulatory receptors were co-expressed in cancers including bladder, breast, colon, head & neck, kidney, lung-adeno, lung squamous, ovarian, pancreatic, prostate, and melanoma cancer. Notably, expression of ICOS on TILs correlates better with that of PD-1 than several other costims.

B. Example 2: Immune Checkpoint Antigen Binding Domains 1. 2A: anti-PD-1 ABDs Examples of antibodies which bind PD-1 were generated in bivalent IgG1 format with E233P/L234V/L235A/G236del/S267K substitutions, illustrative sequences for which are depicted in FIG. 10. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. Additional PD-1 ABDs (including those derived from the above antibodies) were formatted as Fabs and scFvs for use in costim/checkpoint bispecific antibodies, illustrative sequences for which are depicted respectively in FIG. 11 and in the sequence listing.

2. 2B: anti-CTLA-4 ABDs

Antibodies which bind CTLA-4 were generated in bivalent IgG1 format with E233P/L234V/L235A/G236del/S267K substitutions. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. Additional CTLA-4 ABDs (including those derived from the above antibodies) were formatted as scFvs for use in costim/checkpoint bispecific antibodies, illustrative sequences for which are depicted in FIG. 12 and in the sequence listing.

3. 2C: anti-LAG-3 ABDs

Examples of antibodies which bind LAG-3 were generated in bivalent IgG1 format with E233P/L234V/L235A/G236del/S267K substitutions. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. Additional LAG-3 ABDs (including those derived from the above antibodies) were formatted as Fabs for use in costim/checkpoint bispecific antibodies, illustrative sequences for which are depicted in FIG. 13 and in the sequence listing.

4. 2D: anti-TIM-3 ABDs

Examples of antibodies which bind TIM-3 were generated in bivalent IgG1 format with E233P/L234V/L235A/G236del/S267K substitutions, exemplary sequences for which are depicted in FIG. 14. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. The above antibodies were formatted as Fabs for use in costim/checkpoint bispecific antibodies.

5. 2E: anti-PD-L1 ABDs

Prototype antibodies which bind PD-L1 were generated in bivalent IgG1 format with E233P/L234V/L235A/G236del/S267K substitutions, exemplary sequences for which are depicted in FIG. 15. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. The above antibodies were formatted as Fabs and scFvs for use in costim/checkpoint bispecific antibodies.

C. Example 3: Costimulatory Receptor Antigen Binding Domains

Prototype costimulatory receptor antibodies which bind ICOS, GITR, OX40, and 4-1BB were generated in bivalent IgG1 format with E233P/L234V/L235A/G236del/S267K substitutions, sequences for which are depicted in FIGS. 16-19. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human C? constant region. DNA was transfected into HEK293E cells for expression. The above antibodies were formatted as Fabs or scFvs for use in costim/checkpoint bispecific antibodies.

D. Example 4: Engineering Anti-ICOS ABD for Stability and Affinity

The parental variable region of an anti-ICOS antibody (XENP16435; depicted in FIG. 19) was engineered for use as a component in an ICOS x checkpoint bispecific antibody. A library of Fv variants engineered to have optimal affinity and stability was constructed by site-directed mutagenesis (QuikChange, Stratagene, Cedar Creek, Tx.) or additional gene synthesis and subcloning in Fab-His and scFv-His formats and produced as described below.

1. 4A: anti-ICOS Fabs

Amino acid sequences for variant anti-ICOS Fabs are listed in FIG. 20 (the polyhistidine (His6 (SEQ ID NO: 28666)) tags have been removed from the C-terminal of the Fab heavy chains). DNA encoding the two chains needed for Fab expression were generated by gene synthesis and were subcloned using standard molecular biology techniques into the expression vector pTT5. The Fab heavy chain included a C-terminal polyhistidine tag. DNA was transfected into HEK293E cells for expression and resulting proteins were purified from the supernatant using Ni-NTA chromatography. The resultant anti-ICOS Fabs were characterized for stability and affinity.

Differential Scanning Fluorimetry (DSF) experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 seconds. Melting temperatures (Tm) were calculated using the instrument software. The results are shown in FIG. 21.

A series of affinity screens of the anti-ICOS Fabs to human ICOS were performed using Octet, a BioLayer Interferometry (BLI)-based method. Experimental steps for Octet generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the monovalent affinity of the test articles. Specifically, anti-mouse Fc (AMC) biosensors were used to capture mouse IgG2a Fc fusion of ICOS and dipped into multiple concentrations of the test articles. The resulting equilibrium dissociation constants (KD), association rates (ka), and dissociation rates (kd) are presented in Figures FIG. 22 and FIG. 23. Binding affinities and kinetic rate constants were obtained by analyzing the processed data using a 1:1 binding model using ForteBio Octet Data Analysis software (ForteBio). The data from a two separate experiments are depicted in FIG. 22A-B. In a further experiment, streptavidin (SA) biosensors were used to capture ICOS-TEV-Fc-Avi and dipped into the test articles. The data are depicted in FIG. 23. A number of variant anti-ICOS Fabs including XENP22780, XENP22782, XENP22783, and XENP22784 had improved stability while maintaining affinity characteristics similar to a Fab comprising the parental variable regions (XENP22050).

2. 4B: anti-ICOS scFvs

Amino acid sequences for anti-ICOS scFvs are listed in FIG. 24 (the polyhistidine (His6 (SEQ ID NO: 28666)) tags have been removed from the C-terminal of the scFvs). DNA encoding the scFv was generated by gene synthesis and were subcloned using standard molecular biology techniques into the expression vector pTT5. The scFv included a C-terminal polyhistidine tag. DNA was transfected into HEK293E cells for expression and resulting proteins were purified from the supernatant using Ni-NTA chromatography. The resultant anti-ICOS scFvs were characterized for stability in DSF experiments as described above. The data is depicted in FIG. 25.

E. Example 5: Anti-ICOS x Anti-PD-1 Bispecific Antibodies 1. 5A: Prototype Costim/Checkpoint Bottle-Openers Schematics for costim/checkpoint bispecific antibody in the bottle-opener format are depicted as FIG. 2A. Prototype bottle-openers with costimulatory receptor binding Fab arms based on prototype anti-GITR mAb (XENP16438), anti-OX40 mAb (XENP16437), anti-4-1BB mAb (XENP14410) and anti-ICOS mAb (XENP16435) and exemplary anti-PD-1 scFv (XENP19692) arm were produced to investigate their effect on cytokine secretion in an SEB-stimulated PBMC assay. Sequences are depicted in FIG. 26. DNA encoding the three chains needed for bottle-opener expression were generated by gene synthesis and were subcloned using standard molecular biology techniques into the expression vector pTT5. DNA transfected into HEK293E cells for expression and resulting proteins were purified using standard techniques.

a. 5A(a): Prototype Anti-ICOS x Anti-PD-1 Bottle-Opener Enhances Cytokine Secretion Staphylococcal Enterotoxin B (SEB) is a superantigen that causes T cell activation and proliferation in a manner similar to that achieved by activation via the T cell receptor (TCR). Stimulating human PBMC with SEB is a common method for assaying T cell activation and proliferation. PBMCs were simulated with 100 ng/mL SEB for 2 days. Cells were washed twice and restimulated with 100 ng/mL SEB in combination with 20 µg/mL of the indicated test articles. A first bivalent anti-PD-1 antibody based on nivolumab (XENP16432), a second bivalent anti-PD-1 mAb (XENP19686), and a bivalent anti-RSV mAb (XENP15074) were used as controls. 24 hours after treatment, supernatants were assayed for IL-2. The data depicted in FIG. 27 show that each of the costim/checkpoint bottle-openers enhanced cytokine secretion in comparison to the bivalent anti-RSV antibody. Surprisingly, induction of cytokine secretion by XENP22730 is vastly superior to cytokine secretion by bivalent anti-PD-1 antibody alone as well as the other prototype costim/checkpoint bottle-openers, indicating that addition of ICOS binding enhances cytokine production and that ICOS is a better PD-1 partner than other costimulatory receptors for a bispecific antibody.

In another experiment, PBMCs were stimulated with 0.01 µg/mL SEB for 3 days with 20 µg/mL of indicated test articles. As control, test articles were also incubated with naive (non-SEB stimulated) PBMCs. 3 days after treatment, supernatant was assessed for IL-2 secretion as an indicator of T cell activation (depicted in FIG. 28). The data show that neither the anti-PD-1 bivalent antibody nor the anti-ICOS x anti-PD-1 bottle-opener stimulate IL-2 secretion in naive cells. Further, the data show again that XENP20896 enhances IL-2 secretion more than the bivalent anti-PD-1 antibody alone does and that XENP20896 enhances IL-2 secretion more than combination of bivalents (XENP16432 and XENP16435) as well as combination of one-arms (XENP20111 and XENP20266) do.

Costimulatory receptors such as ICOS have previously been found to induce cytokine production only following crosslinking by bivalent antibodies or multimerized ligands (Viera et al. 2004; Sanmamed et al. 2015). In view of the crosslinking mechanisms, it is surprising that monovalent ICOS binding by a single arm in a costim x checkpoint blockade bispecific antibody was able to enhance cytokine production. Further, it is notable that the bispecific antibody was able to enhance cytokine secretion more than bivalent anti-PD-1 mAb in combination with bivalent anti-ICOS mAb (XENP16432+ XENP16435).

b. 5A(b): PD-1 and ICOS Double-Positive Cells are Selectively Occupied by Prototype Anti-ICOS x Anti-PD-1 Bottle-Opener Selective targeting of tumor-reactive TILs co-expressing immune checkpoint receptors (e.g. PD-1) and costimulatory receptors as shown in Example 1 over non-tumor reactive T cells expressing immune checkpoint receptors or costimulatory receptors alone could enhance anti-tumor activity while avoiding peripheral toxicity (as depicted in FIG. 29).

An SEB-stimulated PBMC assay was used to investigate binding of anti-ICOS x anti-PD-1 bottle-opener to T cells. PBMCs were stimulated with 100 ng/mL SEB (staphylococcal enterotoxin B) for 3 days, after which the PBMCs were treated with the indicated test articles for 30 minutes at 4° C. PBMCs were then incubated with APC-labeled one-arm anti-ICOS antibody and FITC-labeled one-arm anti-PD-1 antibody for 30 minutes at 4° C. FIG. 30 and FIG. 31 shows receptor occupancy of a prototype anti-ICOS x anti-PD-1 bottle-opener (XENP20896), one-arm anti-ICOS antibody (XENP20266) and one-arm anti-PD-1 antibody (XENP20111).

The data show that double-positive cells (expressing both PD-1 and ICOS) are selectively occupied by the anti-ICOS x anti-PD-1 bottle-opener (XENP20896) as depicted in FIG. 30, indicating that monovalent ICOS and PD-1 binding is useful for selective targeting. Further, anti-ICOS x anti-PD-1 bottle-opener (e.g. XENP20896) binds more potently to double-positive cells than monovalent, monospecific one-arm anti-PD-1 and anti-ICOS as shown in FIG. 31A.

c. 5A(c): Prototype Anti-ICOS x Anti-PD-1 Bottle-Opener Enhance Engraftment in a GVHD Mouse Study The prototype anti-ICOS x anti-PD-1 bottle-opener was evaluated in a Graft-versus-Host Disease (GVHD) model conducted in NSG (NOD-SCID-gamma) immunodeficient mice. The mice were engrafted with human PBMCs. When NSG mice are injected with human PBMCs, they develop an autoimmune response against the human PBMCs. Treatment of NSG mice injected with human PBMCs with immune checkpoint antibodies (e.g. anti-PD-1) enhance engraftment. Thus, increased engraftment shows efficacy of the antibodies.

10 million human PBMCs were engrafted into NSG mice via IV-OSP on Day 0 followed by dosing with the indicated test articles on Day 1, 8, 15, and 22. Human CD45+ cell counts were measured on Day 14 as an indicator of disease.

The data depicted in Figure A show that the anti-ICOS x anti-PD-1 bottle-opener enhance proliferation of CD45+ cells in human PBMC-engrafted NSG mice as compared to controls (PBS and PBS+PBMC). Further, enhancement is greater using antibodies of the invention than that seen with bivalent anti-PD-1 antibody.

2. 5B: Production of Variant Anti-ICOS x Anti-PD-1 Bottle-Openers with Optimized Anti-ICOS Fab Arms Variant anti-ICOS x anti-PD-1 bottle-openers comprising anti-ICOS Fabs engineered as described in Example 4A were produced as generally described above. Amino acid sequences for variant anti-ICOS x anti-PD-1 bottle-openers are listed in FIG. 32. Amino acid sequences for variant anti-ICOS x anti-PD-1 with FcRn pH 6.0 affinity enhancing substitutions are listed in FIG. 33.

The resultant anti-ICOS x anti-PD-1 bispecific antibodies were characterized for affinity to human and cynomolgus ICOS using Octet as generally described above. In a first set of experiments, AMC biosensors were used to capture mouse IgG2a Fc fusion of ICOS and dipped into multiple concentrations of the test articles (data depicted in FIG. 34). In further experiments, streptavidin (SA or SAX) biosensors were used to capture biotinylated human and cynomolgus IgG1 Fc fusions of human and cynomolgus ICOS and dipped into multiple concentrations of the test articles (data depicted in FIG. 35).

3. 5C: T Cell Surface Binding of Variant Anti-ICOS x Anti-PD-1 Bottle-Openers

Binding of anti-ICOS x anti-PD-1 bispecifics to T cells was measured in an SEB-stimulated PBMC assay. Human PBMCs were stimulated with 100 ng/mL SEB for 3 days. PBMCs were then treated with the indicated test articles and incubated at 4° C. for 30 minutes. After treatment, cells were incubated with FITC-labeled anti-CD3 antibody and APC-labeled anti-human IgG Fc secondary antibody. MFI on CD3+ cells are depicted in FIG. 36A-B.

4. 5D: Receptor Occupancy of Variant Anti-ICOS x Anti-PD-1 Bottle-Openers on T Cells Receptor occupancy of variant anti-ICOS x anti-PD-1 bottle-openers on T cells was measured in an SEB-stimulated PBMC assay. PBMCs were stimulated with 100 ng/mL SEB (staphylococcal enterotoxin B) for 3 days, after which the PBMCs were treated with the indicated test articles for 30 minutes at 4° C. PBMCs were then incubated with APC-labeled one-arm anti-ICOS antibody and FITC-labeled one-arm anti-PD-1 antibody for 30 minutes at 4° C. FIG. 37 depicts the receptor occupancy of variant anti-ICOS x anti-PD-1 bispecific antibodies, corresponding one-arm anti-ICOS antibodies and one-arm anti-PD-1 antibody (XENP20111) on PD-1 and ICOS double-positive T cells. Consistent with the prototype antibodies investigated in Example 1A, each of the bottle-openers binds more potently to double-positive cells than monovalent, monospecific one-arm anti-PD-1 and one-arm anti-ICOS antibodies.

5. 5E: In Vitro Activity of Variant Anti-ICOS x Anti-PD-1 Bottle-Openers in a Cytokine Release Assay Human PBMCs were stimulated with 100 ng/mL SEB for 2 days. Cells were washed and stimulated again with 100 ng/mL SEB in combination with 20 µg/mL of indicated test articles. 24 hours after treatment, cells were assayed for IL-2 (FIG. 38A) and IFN? (FIG. 38B). The data show that anti-ICOS x anti-PD-1 bottle-openers stimulated significantly more cytokine release than bivalent anti-PD-1 antibody (XENP16432) alone, bivalent anti-ICOS antibody (XENP16435) alone, or bivalent anti-PD-1 antibody plus bivalent anti-ICOS antibody in combination.

In a further experiment, human PBMCs were stimulated with 100 ng/mL SEB for 2 days. Cells were washed and stimulated again with 100 ng/mL SEB in combination with 20 µg/mL of indicated test articles. 24 hours after treatment, cells were assayed for IL-2 (FIG. 39A) and IFN? (FIG. 39B).

6. 5F: In Vivo Activity of Variant Anti-ICOS x Anti-PD-1 Bottle Openers in a GVHD Mouse Study In a first study, 10 million human PBMCs were engrafted into NSG mice via IV-OSP on Day 0 followed by dosing with the indicated test articles on Day 1. IFN? levels and human CD45+, CD8+ T cell and CD4+ T cell counts were measured on Day 7, 11 and 14. FIGS. 40A-B respectively depicts IFN? levels on Day 7 and 11. FIGS. 41A-B respectively depict CD45+ cell counts on Day 11 and 14. FIGS. 42A-B respectively depict CD8+ T cell and CD4+ T cell counts on Day 14. FIG. 43 depicts the change in body weight in the mice by Day 14 resulting from exacerbation of GVHD due to T cell expansion and IFN? production.

In a further study with additional variant anti-ICOS x anti-PD-1 bottle-openers, 10 million human PBMCs were engrafted into NSG mice via IV-OSP on Day 0 followed by dosing with the indicated test articles at indicated concentrations on Day 1. IFNγ levels and human CD45+, CD8+ T cell and CD4+ T cell counts were measured on Day 7 and 14. FIG. 44A-B respectively depicts IFN? levels on Day 7 and 14. FIG. 45 depicts CD45+ cell count on Day 14. FIG. 46A-C respectively depict CD8+ T cell count, CD4+ T cell counts and CD8+/CD4+ ratio on Day 14. Body weight of mice were also measured on Day 12 and 15 and depicted respectively in FIG. 47A-B as percentage of initial body weight.

The Figures show that the anti-ICOS x anti-PD-1 bottle-openers enhance engraftment (as indicated by the proliferation of CD45+ cells, CD8+ T cells and CD4+ T cells and decrease in body weight of mice). The observed activity is correlated to the in vitro potency of each variant. Further, a number of the bottle-openers including XENP20896, XENP22744, XENP23092, XENP22730, XENP23104, XENP22974, and XENP23411 enhance engraftment much more than the control bivalent anti-PD-1 antibody (XENP16432) does.

7. 5G: Additional Anti-ICOS ABDs Work in Anti-ICOS x Anti-PD-1 Bottle Opener

Additional anti-ICOS x anti-PD-1 bottle-openers were produced comprising anti-ICOS Fabs based on other anti-ICOS ABDs described in Example 3 as generally described above. Sequences for the additional bottle-openers are depicted in FIG. 48.

In a first experiment, PBMCs were stimulated with 100 ng/mL SEB for 2 days. Cells were washed twice and restimulated with 100 ng/mL SEB in combination with 20 µg/mL of indicated test articles (PBS as control). 24 hours after treatment, supernatants were assayed for IL-2 concentration as depicted in FIG. 49. In a second experiment, PBMCs were stimulated with 10 ng/mL SEB and treated with 20 µg/mL of indicated test articles for 3 days (bivalent anti-PD-1 XENP16432 as control). Supernatants were collected and assays for IL-2. FIG. 50 depicts the fold induction in IL-2 over bivalent anti-RSV mAb.

Consistent with the data in Example 5A(a), XENP20896 stimulated secretion of IL-2. Notably, the additional bottle-openers comprising alternative anti-ICOS ABDs were also able to stimulate secretion of IL-2 demonstrating that the enhancement of cytokine secretion by an anti-ICOS x anti-PD-1 bottle-opener is not unique to ABDs derived from the parental anti-ICOS ABD described in Example 4.

8. 5H: Clear ICOS Signature is Exhibited by Anti-ICOS x Anti-PD-1 Bottle-Openers a. 5H(a): Anti-ICOS x Anti-PD-1 Bispecific Antibodies Induce AKT Phosphorylation ICOS ligation induces AKT phosphorylation in activated T cells (Fos, C et al. 2008), and as such, AKT phosphorylation would be an indicator of ICOS agonism by anti-ICOS x anti-PD-1 bispecific antibodies of the invention.

Human PBMCs were stimulated with 100 ng/mL SEB for 2 days. Following stimulation, CD3+ cells were isolated by negative selection using EasySep™ Human T Cell Enrichment Kit (STEMCELL Technologies, Vancouver, Canada) and then treated with indicated test articles in combination with plate bound anti-CD3 antibody (OKT3; 500 ng/mL). Cells were lysed 30 minutes after treatment and assayed for total AKT and phosphorylated AKT (Ser473) by a multiplexed phosphoprotein assay on MULTI-SPOT 384-Well Spot plates (Meso Scale Discovery, Rockville, Md.). The data are depicted in FIG. 51 as percentage of AKT phosphorylated following treatment.

The data shows no increase in AKT phosphorylation following treatment with negative control bivalent anti-PD-1 mAb (XENP16432). Both bivalent anti-ICOS mAb alone (XENP16435) and XENP16435 in combination with XENP16432 increase AKT phosphorylation demonstrating ICOS ligation and agonism by XENP16435. Surprisingly, despite only monovalent engagement of ICOS, treatment with the anti-ICOS x anti-PD-1 bispecific antibodies induces more AKT phosphorylation than treatment with XENP16435 alone and XENP16435 in combination with XENP16432. The positive AKT phosphorylation data demonstrate a clear signature of ICOS activity with the bispecific antibodies despite monovalent engagement of ICOS.

b. 5H(b): Activated T Helper Cell-Associated Genes Upregulated by Anti-ICOS x Anti-PD-1 Bottle-Openers Guedan et al. (2014) describes gene expression profiles for activated T helper cells (i.e. Th1, Th2, and Th17) and regulatory T cells (Tregs) following activation of ICOS signaling domain-based CAR-Ts. They found that genes related to activated T helper cells such as IL-17A, IL22, IFN?, TNF, and IL-13 were upregulated, while Treg-related genes such as TGFβ1, SMAD3 and FOXP3 were either unchanged or downregulated.

To investigate if engagement of T cells with anti-ICOS x anti-PD-1 bispecific antibodies of the invention led to a similar signature, we used Nanostring technology. PBMCs were stimulated with 100 ng/mL SEB for 2 days. Cells were washed 2 times and restimulated with 100 ng/mL SEB and treated with indicated test articles for 24 hours. RNA was extracted from cells and assayed by nCounter® PanCancer Immune Profiling Panel (NanoString Technologies, Seattle, Wash.) which assays 770 target genes covering immune response. FIG. 52 depicts mean fold induction in expression of a number of Th-related and Treg-related genes over bivalent anti-RSV antibody. FIGS. 53A-F respectively depict fold induction of IL-17A, IL-17F, IL-22, IL-10, IL-9 and IFN? gene expression by the indicated test articles over induction by bivalent anti-RSV mAb.

As depicted in FIGS. 52-53 and consistent with the observation by Gueden et al., Th-related genes associated with ICOS signaling such as IL-17A, IL-17F, IL-22, IL-9, and IFN? are upregulated following treatment with bivalent anti-ICOS mAb and combination of anti-ICOS and anti-PD-1 mAbs. Notably, expression of Th-related genes associated with ICOS signaling are further upregulated following treatment with an anti-ICOS x anti-PD-1 antibody, again indicating a clear ICOS costimulatory signature and dramatic synergy of anti-ICOS and anti-PD-1 engagement by a bispecific antibody.

9. 5I: Alternative Format Anti-ICOS x Anti-PD-1 Bispecific Antibodies

Alternative format costim/checkpoint bispecific antibodies were produced to investigate whether the effect of anti-ICOS x anti-PD-1 bottle-openers was unique to the bottle-opener format or broadly applicable to anti-ICOS x anti-PD-1 bispecific antibodies.

a. 5I(a): Anti-PD-1 x Anti-ICOS Bottle-Opener

Anti-PD-1 x anti-ICOS bottle-openers with an anti-PD-1 Fab generated using DNA encoding anti-PD-1 mAbs (e.g. XENP16432 and XENP29120) as described in Example 2A and anti-ICOS scFvs as described in Example 4B. Bottle-openers were produced as generally described in Example 5A. Sequences for exemplary anti-PD-1 x anti-ICOS bottle-openers are depicted in FIG. 56.

b. 5I(b): Central-scFv

Schematics for the central-scFv format are depicted as FIGS. 55A-55B. DNA encoding anti-ICOS Fab-Fc heavy chains was generated using DNA encoding anti-ICOS Fabs described in Example 4A by standard subcloning into the expression vector pTTS. DNA encoding anti-ICOS-anti-PD-1 Fab-scFv-Fc heavy chains was generated using DNA encoding anti-ICOS Fabs described in Example 4A and anti-PD-1 scFv described in Example 2A by a combination of gene synthesis and standard subcloning into the expression vector pTTS. DNA was transfected into HEK293E cells for expression. Sequences for exemplary anti-ICOS x anti-PD-1 central-scFv antibodies are depicted in FIG. 57.

c. 5I(c): Central-scFv2

A schematic for the central-scFv2 format is depicted as FIG. 55C. DNA encoding anti-ICOS-anti-PD-1 Fab-scFv-Fc heavy chains was generated using DNA encoding anti-ICOS Fabs described in Example 4A and anti-PD-1 scFv described in Example 2A by a combination of gene synthesis and standard subcloning into the expression vector pTT5. DNA was transfected into HEK293E cells for expression. Sequences for exemplary anti-ICOS x anti-PD-1 central-scFv2 antibodies are depicted in FIG. 58.

d. 5I(d): Bispecific mAb

A schematic for the bispecific mAb format is depicted as FIG. 2K. DNA encoding the anti-ICOS heavy and light chains were generated based on the DNA encoding the anti-ICOS Fabs described in Example, and DNA encoding anti-PD-1 heavy and light chains were generated based on the DNA encoding the anti-PD-1 mAbs described in Example 2A. Heavy chain VH genes were inserted via Gibson assembly into pTT5 encoding the human IgG1 constant region with E233P/L234V/L235A/G236del/S267K substitutions. Light chain VL genes were inserted into pTT5 encoding the human C? constant region.

DNA was transfected into HEK293E cells for expression as 2 separate antibodies which are separately expressed and purified by Protein A affinity (GE Healthcare). These antibodies contain heterodimerization-skewing substitutions in the CH3:CH3 interface. 2-Mercaptoethylamine-HCl (2-MEA) was used to induce controlled reduction of interchain disulfide bonds in the two parental IgGs. 2-MEA was then removed allowing the reoxidation of interchain disulfide bonds to occur enabling recombination of the HC-LC pairs (driven by the heterodimerization mutations). Finally, the trispecific antibodies were purified by cation exchange chromatography. Such methods are common in the art (see, for instance, Labrijn (2013) PNAS 110(13):5145-50 or Strop et al. (2012) J Mol Biol 420(3):204-19). Other methods of design and purification known in the art may be used facilitate bispecific mAb production, for instance, common light chain antibodies (Merchant (1998) Nat Biotechnol 16(7):677-81) or heterodimeric Fab domains (Lewis et al. (2014) Nat Biotechnol 32(2):191-8). Sequence for an exemplary anti-PD-1 x anti-ICOS bispecific mAb is depicted in FIG. 59.

e. 5I(e): DVD-IgG

A schematic for the DVD-IgG format is depicted as FIGS. 55A-55D. DNA encoding anti-PD-1-anti-ICOS VH-VH-CH1-Fc heavy chains and VL-VL-C? light chains was generated using DNA encoding anti-ICOS Fabs described in Example 4A and anti-PD-1 scFv described in Example 2A by a combination of gene synthesis and standard subcloning into the expression vector pTT5. DNA was transfected into HEK293E cells for expression. Sequences for exemplary anti-ICOS x anti-PD-1 DVD-IgGs are depicted in FIG. 60.

f. 5I(f): Trident

A schematic for the Trident format is depicted as FIGS. 55A-55D. DNA encoding anti-PD-1 VL-VH-Fc heavy chains and VL-VH light chains was generated using DNA encoding anti-ICOS Fabs described in Example 4A and anti-PD-1 scFv described in Example 2A by a combination of gene synthesis and standard subcloning into the expression vector pTTS. DNA was transfected into HEK293E cells for expression. Sequences for exemplary anti-ICOS x anti-PD-1 Tridents are depicted in FIG. 61.

g. 5I(g): Alternative Format Anti-ICOS x Anti-PD-1 Bispecific Antibodies Enhance Cytokine Secretion Human PBMCs were stimulated with 200 ng/mL SEB for 2 days. Cells were washed twice then re-stimulated with 100 ng/mL SEB and treated with the indicated concentrations of the indicated test articles. 24 hours after treatment, supernatants were assayed for IL-2. The data are depicted in FIG. 62 and show that each of the alternative format bispecific antibodies enhances IL-2 secretion in comparison to bivalent anti-RSV (XENP15074) control. Notably, the majority of these alternative format antibodies enhance IL-2 secretion in comparison to a bivalent anti-PD-1 antibody.

F. Example 6: Costim/Checkpoint Bispecific Antibodies Targeting Different Immune Checkpoint Antigens 1. 6A: Anti-CTLA-4 x Anti-ICOS Anti-CTLA-4 x anti-ICOS bottle-openers were generated with an anti-ICOS Fab derived from XENP16435 and anti-CTLA-4 scFvs derived from ABDs described in Example 2B. Sequence for an exemplary anti-ICOS x anti-CTLA-4 bottle-opener is depicted in FIG. 63. Bispecific mAbs were produced as generally described in Example 5I(c).

2. 6B: Anti-LAG-3 x Anti-ICOS

Anti-LAG-3 x anti-ICOS bispecific antibodies were generated with anti-LAG-3 Fabs derived from ABDs described in Example 2C and an anti-ICOS Fab derived from XENP16435. Sequences for exemplary anti-LAG-3 x anti-ICOS bispecific antibodies are depicted in FIG. 64. Bispecific mAbs were produced as generally described in Example 5I(c).

3. 6C: anti-TIM-3 x anti-ICOS

Anti-TIM-3 x anti-ICOS bispecific antibodies were generated with anti-TIM-3 Fabs derived from ABDs described in Example 2D and an anti-ICOS Fab derived from XENP16435. Sequence for an exemplary anti-TIM-3 x anti-ICOS bispecific antibody is depicted in FIG. 65. Bispecific mAbs were produced as generally described in Example 5I(c).

4. 6D: Anti-PD-L1 x Anti-ICOS

Anti-PD-L1 x anti-ICOS bottle-openers were generated with anti-PD-L1 Fabs derived from ABDs described in Example 2E and anti-ICOS scFvs as described in Example 4B. Sequences for exemplary anti-PD-L1 x anti-ICOS bispecific antibodies are depicted in FIG. 66. The bottle-openers were produced as generally described in Example 5A.

5. 6E: Additional Costim x Checkpoint Blockade Bispecific Antibodies Function to Enhance Cytokine Secretion Human PBMCs were stimulated with 200 ng/mL SEB for 2 days. Cells were washed twice then restimulated with 100 ng/mL SEB and treated with the indicated concentrations of the indicated test articles (as described above). 24 hours after treatment, supernatants were assayed for IL-2. The data are depicted in FIG. 67 and show that each of the additional costim x checkpoint blockade bispecific antibodies enhance IL-2 secretion in comparison to bivalent anti-RSV (XENP15074) control. Notably, the majority of these alternative checkpoint blockade antibodies (but not all, e.g. TIM-3 blockade) enhance IL-2 secretion in comparison to a bivalent anti-PD-1 antibody (XENP16432).

G. Example 7: Monovalent Ligation of ICOS is Superior to Bivalent Crosslinking In Example 5A(a), it was surprisingly found that anti-ICOS x anti-PD-1 antibody worked to enhance cytokine secretion despite monovalent binding of ICOS which is contrary to the crosslinking of costimulatory receptors such as ICOS which was thought to be necessary for stimulation of cytokine production. In Example 5H(a), it was surprisingly found that anti-ICOS x anti-PD-1 antibodies enhanced AKT phosphorylation (a signature of ICOS agonism) over bivalent anti-ICOS mAbs. In this section, we further examine this trend in which monovalent binding of ICOS appears to be superior to bivalent binding of ICOS.

1. 7A: Production of One-Arm Anti-ICOS Fab-Fc Antibodies

Amino acid sequences for illustrative one-arm anti-ICOS Fab-Fc antibodies are listed in FIG. 68. DNA encoding the three chains needed for antibody expression were generated by gene synthesis and were subcloned using standard molecular biology techniques into the expression vector pTT5. DNA was transfected into HEK293E cells for expression and resulting proteins were purified using standard techniques.

The resultant one-arm anti-ICOS Fab-Fc antibodies were characterized for affinity to human ICOS using Octet. Anti-mouse Fc (AMC) biosensors were used to capture mouse IgG2a Fc fusion of ICOS and dipped into multiple concentrations of the test articles. The resulting equilibrium dissociation constants (KD), association rates (ka), and dissociation rates (kd) are presented in FIG. 69. Binding affinities and kinetic rate constants were obtained by analyzing the processed data using a 1:1 binding model using ForteBio Octet Data Analysis software (ForteBio).

2. 7B: Monovalent One-Arm Anti-ICOS Fab-Fc Antibodies Promote Greater AKT Activation in PBMCs than Bivalent Anti-ICOS Antibody PBMCs were stimulated with 100 ng/mL SEB for 2 days. Following stimulation, CD3+ T cells were isolated by negative selection using EasySep™ Human T Cell Enrichment Kit (STEMCELL Technologies, Vancouver, Canada) and then treated with indicated test articles in combination with plate bound anti-CD3 antibody (OKT3; 500 ng/mL). Cells were lysed 30 minutes after treatment and assayed for total AKT and phosphorylated AKT (Ser473) by a multiplexed phosphoprotein assay on MULTI-SPOT 384-Well Spot plates (Meso Scale Discovery, Rockville, Md.). The data are depicted in FIG. 70 as percentage of AKT phosphorylated following treatment.

Consistent with Example X, the anti-ICOS x anti-PD-1 bispecific antibodies promoted significantly greater AKT activation than bivalent anti-ICOS antibody. Surprisingly, monovalent one-arm anti-ICOS Fab-Fc antibodies enhanced also promoted significantly greater AKT activation than bivalent anti-ICOS antibody to a level comparable to the bispecific antibodies.

3. 7C: Monovalent Agonism of ICOS Works with Multiple Anti-ICOS ABDs

CD3+ T cells were isolated by negative selection using EasySep™ Human T Cell Enrichment Kit (STEMCELL Technologies, Vancouver, Canada) and then treated with indicated test articles in combination with plate bound anti-CD3 antibody (OKT3; 500 ng/mL). Cells were lysed 30 minutes after treatment and assayed for total AKT and phosphorylated AKT (Ser473) by a multiplexed phosphoprotein assay on MULTI-SPOT 384-Well Spot plates (Meso Scale Discovery, Rockville, Md.). The data is depicted in FIG. 74 and show that monovalent anti-ICOS Fab-Fc antibodies comprising various anti-ICOS ABDs were able to induce AKT phosphorylation.

H. Example 8: Investigating In Vitro Binding by XmAb23104

1. XmAb23104 Binding to SEB-Stimulated T Cells

Staphylococcal Enterotoxin B (SEB) is a superantigen that causes T cell activation and proliferation in a manner similar to that achieved by activation via the T cell receptor (TCR), including expression of checkpoint receptors such as PD-1. Accordingly, human PBMCs from 3 separate donors were stimulated with 100 ng/mL SEB for 3 days. Cells were then treated with the following test articles at the indicated concentrations for 30 minutes: XmAb23104; XENP20111, a one-armed scFv-Fc based on the anti-PD-1 arm from XmAb23104; and XENP24901, a one-armed Fab-Fc based on the anti-ICOS arm from XmAb23104. Following incubation, cells were washed and stained with anti-human-Fc-A647 and anti-CD3-FITC. Cells were washed two more times and assayed by FACS. MFI on CD3+ T cells indicating binding of the test articles are depicted in FIGS. 90A-D, respectively for each donor.

The data show that, in PBMCs from each of the donors, XmAb23104 binds more avidly to CD3+ T cells compared to one-armed controls XENP20111 and XENP24901, demonstrating that binding to human T cells is significantly better by bispecific antibody XmAb23104, where each arm monovalently binds a different antigen, than by monovalent, monospecific antibodies.

2. Occupancy of PD-1 and ICOS on SEB-Stimulated T Cells by XmAb23104

Receptor occupancy by XmAb23104 was measured in an SEB-stimulated PBMC assay. Human PBMCs were stimulated with 500 ng/mL SEB for 3 days. Cells were then treated with the following test articles at indicated concentrations for 30 minutes: XmAb23104; XENP20111; XENP24901; XENP19686, a bivalent mAb based on the anti-PD-1 arm from XmAb23104; XENP16435, a bivalent mAb based on the parental clone from which the anti-ICOS arm of XmAb23104 was generated; and XENP15074, a bivalent anti-RSV mAb used as a control. Following incubations, cells were pelleted and stained with A488-conjugated XENP20111, A647-conjugated XENP24901, and BV510-conjugated anti-CD3 mAb. Cells were then washed two times and assayed by FACS. FIGS. 91A-D show receptor occupancy following treatment with the various test articles as depicted by percentage of various populations of $CD3^+$ T cells with unoccupied PD-1 and/or ICOS receptors as indicated by staining. For example, occupancy of PD-1 receptors decreases the percentage of $ICOS^+PD-1^+$ and $ICOS^-PD-1^+$ populations and increases the percentage of $ICOS^+PD-1^-$ and $ICOS^-PD-1^-$ populations. FIGS. 92A-B respectively show the amount of unoccupied of PD-1 and ICOS receptors on $ICOS^+PD-1^+CD3^+$ T cells following treatment with test articles as indicated by XENP20111 and XENP24901 binding.

I. Example 9: XmAb23104 Exhibits a Multi-Gene Expression Signature Consistent with ICOS Costimulation FIG. 93 depicts the fold change in expression of additional genes (as determined by Nanostring nCounter® in the experiment described in Example 5H(b)) between XmAb23104, anti-PD-1 mAb (XENP19686), anti-ICOS mAb (XENP16435), anti-PD-1 mAb (XENP19686) in combination with anti-ICOS mab (XENP16435), and negative control anti-RSV mAb (XENP15074).

J. Example 10: XmAb23104 Enhances Anti-Tumor Responses in Mice

NOD SCID gamma (NSG) mice were engrafted intradermally with either $3 \times 10^6$ pp65-expressing MCF-7 cells or $2 \times 10^6$ pp65-expressing MDA-MB-231 cells in the rear flank on Day −14. On Day 0, mice were engrafted intraperitoneally with $5 \times 10^6$ human PBMCs from a $CMV^+$ donor that screened positive for T cell pp65 reactivity. Mice were treated weekly with XmAb23104 (control mice were dosed with PBS) for 4 weeks (or 4 total doses). Tumor volumes were monitored by caliper measurements and data are shown (days post 1st dose) in FIGS. 94 and 95.

K. Example 11: Further In Vitro Characterization of XmAb23104

1. 11A: XmAb23104 Blocks PD-1 Binding by PD-L1 and PD-L2

HEK293T cells stably expressing ICOS (Crown Bioscience, Santa Clara, Calif.) were stably transfected with a pCMV6-AC-GFP vector encoding PD-1 (OriGene, Rockville, Md.). Cells were treated with the following test articles for 30 minutes at 4° C.: XmAb23104, XENP16432 (a bivalent anti-PD-1 mAb based on nivolumab), XENP20111 (a monovalent anti-PD-1 scFv-Fc fusion based on the anti-PD-1 arm from XmAb23104), and XENP24901 (a monovalent anti-ICOS Fab-Fc fusion based on the anti-ICOS arm from XmAb23104 with M428L/N434S Xtend Fc; sequence depicted in FIG. 1). Cells were washed and incubated with A647-conjugated PD-L1-Fc (1 µg/mL; sequence depicted in FIG. 2A) or A647-conjugated PD-L2-Fc (0.1 µg/mL; sequence depicted in FIG. 2B) for 30 minutes at 4° C. Cells were washed twice more and analyzed by flow cytometry. PD-L1 and PD-L2 binding (as indicated by A647 MFI on GFP+ cells) following treatment with the indicated test articles are depicted respectively in FIGS. 3A-B. The data show that XmAb23104, XENP16432, and XENP20111 blocked PD-L1 and PD-L2 binding to PD-1$^+$ICOS$^+$ cells in a dose dependent manner, while XENP24901 did not block PD-L1 and PD-L2 binding.

2. 11B: XmAb23104 Blocks ICOS Binding by ICOSL

HEK293T cells stably expressing ICOS (Crown Bioscience, Santa Clara, Calif.) were stably transfected with a pCMV6-AC-GFP vector encoding PD-1 (OriGene, Rockville, Md.). Cells were treated with the following test articles for 30 minutes at 4° C.: XmAb23104, XENP20111, and XENP24901. Cells were washed and incubated with A647-conjugated ICOSL-Fc (0.5 µg/mL; sequence depicted in FIG. 4) for 30 minutes at 4° C. Cells were washed twice more and analyzed by flow cytometry. ICOSL binding (as indicated by A647 MFI on GFP+ cells) following treatment with the indicated test articles is depicted in FIG. 5. The data show that XmAb23104 and XENP24901 blocked ICOSL binding to PD-1$^+$ICOS$^+$ cells in a dose dependent manner, while XENP20111 did not block ICOSL binding.

3. 11C: XmAb23104 Binds Cynomolgus T Cells

Towards preclinical studies, it is helpful to have antibodies that are cross-reactive for human and cynomolgus monkeys. Accordingly, we confirmed whether XmAb23104 (and its component arms) could bind cynomolgus T cells. PBMCs collected from 4 cynomolgus monkeys were stimulated with 100 ng/mL SEB for 3 days. Cells were then treated with the following test articles at the indicated concentrations: XmAb23104, XENP20111, and XENP24901. Following incubation, cells were washed and stained with anti-human-Fc-A647 and anti-CD3-FITC. Cells were washed two more times and assayed by FACS. MFI on CD3$^+$ T cells indicating binding of the test articles are depicted in FIGS. 6A-D respectively for each animal. The data show that XmAb23104, as well as its component Fab and scFv arms as Fc-fusions, bound to CD3$^+$ cells from cynomolgus monkeys.

4. 11D: XmAb23104 Enhances IFNγ and IL-2 Secretion in an SEB-Stimulated PBMC Assay Human PBMCs from 21 donors were stimulated with 100 ng/mL SEB for 2 days. Cells were washed two times and re-stimulated with 100 ng/mL SEB and 20 µg/mL of the following test articles for 24 hours: XENP16432, XENP16435 (a bivalent mAb based on the parental clone from which the anti-ICOS arm of XmAb23104 was generated), XENP20111, XENP24901, XENP16432 in combination with XENP16435, XENP20111 in combination with XENP24901, and XmAb23104 (as well as XENP15074 as control). Following incubation with the test articles, cell supernatants were collected and assayed for IFNγ and IL-2. Data depicting IFNγ secretion are depicted in FIG. 7A, and data depicting IL-2 secretion are depicted in FIGS. 7B and 8. The data show that XmAb23104 is superior at induction of IFNγ and IL-2 secretion in comparison to a bivalent anti-PD-1 mAb based on nivolumab.

5. 11E: XmAb23104 Enhances IFNγ Secretion in an MLR Assay

The ability of XmAb23104 to enhance IFNγ secretion was investigated in a mixed-lymphocyte reaction (also known as a mixed-lymphocyte reaction or MLR). Mixing lymphocytes from unique donors induces allogeneic T cell activation and proliferation, and subsequently upregulation of checkpoint receptors such as PD-1. Human PBMCs from 11 unique donors were mixed to generate 22 unique MLR mixes (400,000 cells/donor in a total volume of 100 µL) and treated with 20 µg/mL of the following test articles for 5 days: XENP16432, XENP19686 (a bivalent anti-PD-1 mAb based on the anti-PD-1 arm from XmAb23104), XENP16435, XENP21622 (a monovalent anti-PD-1 scFv-Fc fusion based on the anti-PD-1 arm from XmAb23104 with M428L/N424S Xtend Fc; sequence depicted in FIG. 9), XENP20266 (a monovalent anti-ICOS Fab-Fc fusion based on the parental clone from which the anti-ICOS arm of XmAb23104 was generated), XENP16432 in combination with XENP16435, XENP21622 in combination with XENP20266, or XmAb23104 (and XENP15074 as control). Following incubation, cell supernatants were collected and assayed for IFNγ. Data depicting induction of IFNγ by indicated test articles over control anti-RSV mAb (XENP15074) are shown in FIG. 10. Consistent with Example 1D, the data show that XmAb23104 is superior at induction of IFNγ secretion in comparison to a bivalent anti-PD-1 mAb based on nivolumab.

6. 11F: XmAb23104 Enhanced Cytokine Secretion is Dose-Dependent Manner

Human PBMCs from 2 donors were stimulated with 100 ng/mL SEB for 2 days. Cells were then washed two times and re-stimulated with 100 ng/mL SEB in combination with XmAb23104 or a combination of XENP20111 and XENP24901 (at equimolar PD-1 and ICOS binding concentrations relative to XmAb23104). 24 hours after treatment, cell supernatant was collected and assayed for IFNγ and IL-2, as depicted respectively in FIGS. 11-12.

L. Example 12: XmAb23104 in Combination with Anti-CTLA-4 mAb

Next we investigated the effect of combining XmAb23104 with an additional checkpoint inhibitor. Human PBMCs from 22 donors were stimulated with 100 ng/mL SEB for 2 days. Cells were washed two times, and re-stimulated with 100 ng/mL SEB in combination with 20 μg/mL XmAb23104 alone, XENP16433 (a bivalent anti-CTLA-4 mAb based on ipilimumab; sequence depicted in FIG. 13), or XmAb23104 in combination with XENP16433 (and XENP15074 as a control). Cell supernatant was then collected and assayed for IFNγ and IL-2, as depicted respectively in FIGS. 14A-B. The data show that the combination of XmAb23104 with XENP16433 induced greater cytokine secretion than each antibody alone.

M. Example 13: XmAb23104 Enhances Greater T Cell Activation In Vitro than αPD-1 Alone as Indicated by IL-2 Secretion 21 unique MLR reactions were treated with 20 μg/mL of XmAb23104, XENP16432 (a bivalent mAb based on nivolumab with ablated effector function), or XENP15074 (a bivalent anti-RSV mAb as isotype control) for 6 days. Cell supernatants were collected and assayed on MULTI-SPOT 384-Well Spot plates (Meso Scale Discovery, Rockville, Md.) for IL-2 concentration. Data showing fold change in IL-2 secretion are depicted in FIG. 310, and show that XmAb23104 enhances greater T cell activation than anti-PD-1 mAb alone.

N. Example 14: XmAb23104 Induces Greater Human Leukocyte Expansion and GVHD in huPBMC-Engrafted NSG Mice than αPD-1 Alone NSG mice (10 per group) were engrafted via IV-OSP with $10 \times 10^6$ human PBMCs on Day −1. On Days 0, 7, 14, and 21, mice were dosed with XmAb23104 or XENP16432. Mice were weighted on Days −2, 3, 6, 10, 13, 18, 21, 24, and 27, and blood was drawn on Days 8, 14, 21 and 28 to count leukocyte populations. and $CD45^+$ cell counts on Day 8 are depicted in FIG. 111, and changes in body weight over time (as a percentage of initial body weight on Day −2) are depicted in FIG. 112. The data show that XmAb23104 induced greater leukocyte expansion and enhanced GVHD in huPBMC-engrafted NSG mice in comparison to αPD-1 alone.

O. Example 15: XmAb23104 Enhances Allogeneic Anti-Tumor Response in NSG Mice NSG mice (10 per group) were intradermally inoculated with 3×106 pp65-transduced MCF-7 cells on Day −14. Mice were then intraperitoneally injected with 5×106 pp65-reactive human PBMCs (or PBS for control) and treated with the indicated test articles on Day 0, and further treated with the indicated test articles on Days 7, 14, and 21. CD45+ cell counts on Day 21 post-huPBMC engraftment are depicted in FIG. 113. Tumor volume on Days 21 and 38 post-huPBMC engraftment are depicted in FIGS. 114 and 115. Tumor volume as a time course over the duration of the study are depicted in FIG. 116. The data show that XmAb23104 enhances allogeneic anti-tumor response in NSG mice. Notably, treatment with anti-PD-1 x anti-ICOS bispecific XmAb23104 is more efficacious than PD-1 blockade alone (using a bivalent anti-PD-1 mAb).

P. Example 16: Costim x Checkpoint Blockade Bispecific Antibodies are Highly Active In Vivo Here we show an earlier GVHD study investigating prototype anti-PD-1 x anti-ICOS XENP20896 and prototype dual checkpoint inhibitor bispecific antibody XENP20053 (blocking PD-1 and CTLA-4 checkpoint receptors; sequences for which are depicted in FIG. 117) in a GVHD study.

NSG mice (10 per group) were injected with PBMC on Day 0, and then treated with anti-PD-1 mAb, anti-PD-1 mAb in combination with anti-CTLA-4 mAb, anti-PD-1 x anti-CTLA-4 bispecific XENP20053, or anti-PD-1 x anti-ICOS bispecific XENP20896 on Days 1, 8, 15, 22, and 29. CD45+ cell counts on Day 14 post-huPBMC engraftment are depicted in FIG. 118. The data show that anti-PD-1 x anti-ICOS bispecific XENP20896 is highly active in vivo, and enhances engraftment in comparison to anti-PD-1 blockade alone with an anti-PD-1 antibody, dual checkpoint blockade with anti-PD-1 and anti-CTLA-4 antibodies, as well as dual checkpoint blockade with an illustrative anti-PD-1 x anti-CTLA-4 bispecific antibody.

Q. Example 17: XmAb23104 Does Not Induce Cytokine Release in Naive T Cells and is Not Superagonistic PBMCs were thawed overnight and treated with 20 μg/mL of indicated soluble or plate bound test articles for 24 hours. Anti-CD3 antibody was clone OKT3. Cell supernatants were then collected and assayed with V-PLEX Proinflammatory Panel 1 Human Kit (Meso Scale, Rockville, Md.). Each point represents a unique human donor tested in technical singlet. Paired t tests were used to determine statistical significance (n.s. signifies a p-value>0.05). The data depicted in FIG. 119 show that XmAb23104 does not induce cytokine release (A: IFNγ; B: IL-1ß; C: IL-2; D: IL-4; E: IL-8; F: IL-6; G: IL-10; H: IL-12p70; I: IL-13; J: TNFα) in naive T cells.

Superagonstic properties of XmAb23104 was also assessed by air-drying per the Stebbings protocol (Stebbings R. et al. 2007). Air-drying of test articles was achieved by drying in a SpeedVac™ for 2 hours at room temperature. Human PBMCs were treated for 24 hours with 10 μg of air-dried XmAb23104, and activity was compared to 10 μg of air-dried XENP15074 (anti-RSV negative isotype control), the superagonist TGN1412 (XENP29154; sequences for which are depicted in FIG. 120, or anti-CD3 (OKT3). TGN1412 did not possess any activity when bound to the assay plate using an aqueous adsorption method; however, air-dried TGN1412 (as well as anti-CD3 mAb) promoted IFNγ, IL-1β, IL-2, IL-4, IL-6, IL-8, IL-10, IL-12p70, IL-13, and TNF cytokine secretion from unstimulated human PBMC. In comparison, the cytokine levels in PBMCs R. Example 18: Further Characterization of Binding by XmAb23104 treated with air-dried XmAb23104 remained similar to the negative control of air-dried XENP15074 (data shown in FIG. 121).

1. A: XmAb23104 Binds Human and Cynomolgus PD-1 and ICOS

Binding of XmAb23104 to human and cynomolgus PD-1 and ICOS was characterized using Octet, a BioLayer Interferometry (BLI)-based method. Binding affinities were obtained by analyzing the processed data globally using a 1:1 binding model. Octet sensorgrams are shown in FIG. 128 and FIG. 129. The resulting equilibrium dissociation constants ($K_D$), association rate constants ($k_a$), and dissociation constants ($k_d$) are presented in FIG. 130. Affinities for both human and cynomolgus PD-1 were measured at approximately 2.8 and 5.8 nM respectively. Binding affinities for human and cyno ICOS were 2.9 and 2.6 nM respectively.

2. B: XmAb23104 Competes for Binding with Ligands of PD-1 and ICOS

Binding of PD-L1 and PD-L2 to PD-1 with and without XmAb23104 was characterized using Octet, a BioLayer Interferometry (BLI)-based method. Octet sensorgrams are shown in FIG. 132. In both cases, 100 nM PD-1 show a binding signal with their ligands (PDL1/PDL2). In the presence of excess XmAb23104, pre-incubated with PD-1 at room temperature for 1 hour prior to the experiment, there is no binding signal observed to any ligands due to the competition of XmAb23104 with PD-1 for its ligands PD-L1 and PD-L2.

In another experiment to investigate the competition of XmAb23104 with ICOS ligand (ICOSL) and well as with PD-1 ligands (PD-L1 and PD-L2), HEK 293T cells expressing PD-1 and ICOS were incubated with various concentrations of XmAb23104 for 30 minutes at 4° C. Following incubation, 1 µg/mL PD-L1-mFc-Alexa647, 0.1 µg/mL PD-L1-mFc-Alexa647, or 0.5 µg/mL ICOSL-mFc-Alex647 was added and incubated for 30 minutes at 4° C. Binding of soluble ligands was visualized with flow cytometry. Data are depicted in FIG. 119, and show that XmAb23104 blocked binding of soluble PD-L1 ($EC_{10}$ 1 ng/mL and $EC_{90}$ 7100 ng/mL) and PDL2 ($EC_{10}$ 3 ng/mL and $EC_{90}$ 5300 ng/mL) antigen binding to cell surface-expressed PD1 receptor antigen in a dose-dependent fashion, as well as binding of soluble ICOSL ($EC_{10}$ 20 ng/mL, $EC_{90}$ 600 ng/mL) to cell surface-expressed ICOS receptor in a dose-dependent fashion.

3. C: XmAb23104 does not bind FcγR

Binding of XmAb23104 to human, cynomolgus, and mouse FcγRs was characterized using Octet, a BioLayer Interferometry (BLI)-based method. A comparator antibody was also tested using similar methods: anti-CD19 antibody with a native IgG1 constant region. Octet sensorgrams are shown in the FIG. 127 to FIG. 129. While the expected binding patterns for a native human IgG1 antibody were observed for the comparator antibody, no binding for any of the FcγRs was detected for XmAb23104.

4. D: XmAb23104 Binds Human, Cynomolgus, and Mouse FcRn at pH 6.0

Binding of XmAb23104 to human, cynomolgus, and mouse FcRn at pH 6.0 was characterized using Octet, a BioLayer Interferometry (BLI)-based method. A comparator antibody was also tested using similar methods: XENP20896, an anti-PD1×anti-ICOS bispecific antibody containing the same variable regions and engineered constant regions as XmAb23104 but lacking the amino acid substitutions XmAb23104 contains for enhancing FcRn binding. Binding affinities were obtained by analyzing the processed data globally using a 1:1 Langmuir model. Octet sensorgrams are shown in FIG. 131. The resulting equilibrium dissociation constants (KD) are presented Figure. Affinities measured for XmAb23104 are tighter than those measured for the comparator, indicating that the Fc substitutions contained in XmAb23104 improve the affinity for FcRn at pH 6.0, the physiologically relevant pH for endosome trafficking.

5. E: XmAb23104 Simultaneously Binds PD-1 and ICOS

Binding of XmAb23104 to both ICOS and PD1 antigens was tested using an in-tandem dip approach using BLI technology on the Octet HTX instrument. First, biosensors were loaded with ICOS, then dipped into either XmAb23104 or buffer as a control, and finally, into PD-1. FIG. 132 shows the binding sensorgrams which indicate that XmAb23104 binds to both antigens simultaneously. The XmAb23104 sensorgram continues to increase in signal during the final PD-1 antigen dip while the control sensorgram with no XmAb23104 loaded remains flat.

S. Example 19: Further In Vitro Characterization of XmAb23104

1. A: XmAb23104 Dose-Dependently Promoted IL-2 and IFNγ Secretion from SEB-Stimulated Human PBMC IL-2 and IFNγ production was assessed in SEB-stimulated PBMC treated with soluble XmAb23104. Human PBMC (100,000) were cultured in RPMI1640 with 10% FBS and stimulated with 100 ng/mL SEB (48 hours or 96 hours; 37° C.). Logistical considerations necessitated two sets of pre-stimulation conditions; of note, 96 hours of pre-stimulation abrogates detection of IL-2. Following stimulation, cells were washed two times in warm culture medium and then cultured in medium containing the indicated amount of XmAb23104 plus 100 ng/mL SEB (18 hours; 37° C.). To evaluate cytokine release, culture supernatant was collected 18 hours after treatment, then assayed for IL-2 and IFNγ secretion by ELISA (MSD® format) per the manufacturer's instructions. Samples were assayed in technical singlet.

Soluble XmAb23104 promoted a dose-dependent increase in IL-2 and IFNγ in all 19 donors tested with variable maximum amounts of cytokine expression induced between donors varying approximately between 1 ng/mL to 10 ng/mL for IL-2 (FIG. 133) and from 5 ng/mL to 25 ng/mL for IFNγ (FIG. 134). The potency was derived from curve fits, with least-squares methods all providing acceptable curve fits from which the EC values were derived. The average potency of XmAb23104 to induce IL-2 release from SEB-stimulated PBMC is: $EC_{10}$ 44 ng/mL, $EC_{20}$ 79 ng/mL, $EC_{30}$ 125 ng/mL, $EC_{50}$ 273 ng/mL, $EC_{80}$ 1201 ng/mL, and $EC_{90}$ 3215 ng/mL. The average potency of XmAb23104 in stimulating IFNγ release from human SEB-stimulated PBMC is: $EC_{10}$ 21 ng/mL, $EC_{20}$ 34 ng/mL, $EC_{30}$ 48 ng/mL, $EC_{50}$ 81 ng/mL, $EC_{80}$ 206 ng/mL, and $EC_{90}$ 384 ng/mL.

2. B: XmAb23104 Dose-Dependently Promotes IFNγ Secretion from SEB-Stimulated Cynomolgus PBMC Because IFNγ release was the most sensitive cytokine induced by XmAb23104 in human PBMC, we also quantified IFNγ secretion from SEB-stimulated PBMC from 10 cynomolgus monkeys. Cynomolgus PBMC (400,000) were cultured in RPMI1640 with 10% FBS and stimulated with 100 ng/mL SEB. Following stimulation, cells were washed two times in warm culture medium and then cultured in medium containing the indicated amount of XmAb23104 plus 100 ng/mL SEB (18 hours; 37° C.). To evaluate cytokine release, culture supernatant was collected 18 hours after treatment and assayed for IFNγ secretion by ELISA (MSD® format) per the manufacturer's instructions. Samples were assayed in technical singlet, data for which are depicted in FIG. 135.

The potency of XmAb23104 was derived from the five out of 10 monkey PBMC that generated data that could be fit to a sigmoidal dose response curve. XmAb23104 stimulated IFNγ release from monkey PBMC with the following average effective potencies: EC10 32 ng/mL, EC20 45 ng/mL, EC30 56 ng/mL, EC50 81 ng/mL, EC80 155 ng/mL, and EC90 233 ng/mL. For comparison, the EC50 for IFNγ release from SEB stimulated human PBMC was 81 ng/mL, which has similar potency to the monkey SEB stimulated PBMC.

T. Example 20: XmAb23104 Anti-Tumor Response is Dose-Dependent

In the study described in Example 15 investigating the enhancement of allogeneic anti-tumor response in NSG mice by XmAb23104, treatment with additional concentrations of XmAb23104 was investigated. The data depicted in FIGS. 114-116 show treatment with 5.0 mg/kg of XmAb23104. In FIG. 136 and FIG. 137, we depict data additionally showing treatment with 0.3 mg/kg and 1.0 mg/kg of Xmab23104.

U. Example 21: XmAb23104 Enhances Induction of Leukocyte Expansion in huPBMC-Engrafted NSG Mice in Comparison to Comparator Anti-ICOS mAb Since JTX-2011 is being administered to patients in combination with nivolumab, the leukocyte expanding activity of XmAb23104 was compared to the activity of JTX-2011 alone (in-house produced as XENP23058; sequences depicted in FIG. 138) and in combination with XENP16432 (anti-PD-1 mAb based on nivolumab with E233P/L234V/L235A/G236del/S267K ablation variants) in a mouse GVHD study. We also investigated the leukocyte expanding activity of XENP23057 (anti-ICOS mAb based on JTX-2011 with E233P/L234V/L235A/G236del/S267K ablation variants; sequences depicted in FIG. 139) alone and in combination with XENP16432. NSG mice were engrafted with $5\times10^6$ huPBMCs on Day −1, followed by dosing with the indicated test articles at indicated concentrations on Days 0, 7, 14, and 21. Mice were bled and whole blood analyzed to investigate the expansion of various human lymphocyte populations, data for which are depicted in FIG. 140 for Day 21.

Notably, the data show that JTX-2011 (XENP23058), alone and in combination with XENP16432, decreased human leukocytes in comparison to induction of leukocyte expansion by XENP16432 and XmAb23104. We reasoned that this is due to the WT IgG1 backbone of XENP23058 which induced depletion of ICOS positive cells by ADCC or CDC through binding of activating FcγR. Consistent with this reasoning, XENP23057 which has ablated FcγR binding, alone and in combination with XENP16432, induced expansion of human leukocytes.

SEQUENCE LISTING (30385 sequences)

SEQ ID NO: 1 - protein, 222 aa, Artificial Sequence
  Description of Artificial Sequence: Synthetic polypeptide
  XENP022721 1C11_H1L3_Fab Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2 - protein, 117 aa, Artificial Sequence
  Description of Artificial Sequence: Synthetic polypeptide
  VH of XENP022721
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSS

SEQ ID NO: 3 - protein, 5 aa, Artificial Sequence
  Description of Artificial Sequence: Synthetic peptide
  XENP022721 vhCDR1
HYGMN

SEQ ID NO: 4 - protein, 17 aa, Artificial Sequence
  Description of Artificial Sequence: Synthetic peptide
  XENP022721 vhCDR2
WINTYTGEPTYADKFQG

SEQ ID NO: 5 - protein, 8 aa, Artificial Sequence
  Description of Artificial Sequence: Synthetic peptide
  XENP022721 vhCDR3
DYYGSSPY

SEQ ID NO: 6 - protein, 219 aa, Artificial Sequence
  Description of Artificial Sequence: Synthetic polypeptide
  XENP022721 1C11_H1L3_Fab Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7 - protein, 112 aa, Artificial Sequence
  Description of Artificial Sequence: Synthetic polypeptide
  VL of XENP022721
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 8 - protein, 16 aa, Artificial Sequence
  Description of Artificial Sequence: Synthetic peptide
  XENP022721 vlCDR1
KSSQSIVHSNGNTYLE

SEQ ID NO: 9 - protein, 7 aa, Artificial Sequence
  Description of Artificial Sequence: Synthetic peptide
  XENP022721 vlCDR2
KVSNRFS

SEQ ID NO: 10 - protein, 9 aa, Artificial Sequence
  Description of Artificial Sequence: Synthetic peptide
  XENP022721 vlCDR3
FQGSHVPNT

SEQ ID NO: 11 - protein, 222 aa, Artificial Sequence
  Description of Artificial Sequence: Synthetic polypeptide
  XENP022722 1C11_H2L1_Fab Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 12 - protein, 117 aa, Artificial Sequence
  Description of Artificial Sequence: Synthetic polypeptide
  VH of XENP022722
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSS

SEQ ID NO: 13 - protein, 5 aa, Artificial Sequence
  Description of Artificial Sequence: Synthetic peptide
  XENP022722 vhCDR1
HYGMN

SEQ ID NO: 14 - protein, 17 aa, Artificial Sequence
  Description of Artificial Sequence: Synthetic peptide
  XENP022722 vhCDR2
WINTYTGEPTYADSVKG

SEQ ID NO: 15 - protein, 8 aa, Artificial Sequence
  Description of Artificial Sequence: Synthetic peptide
  XENP022722 vhCDR3
DYYGSSPY

SEQ ID NO: 16 - protein, 219 aa, Artificial Sequence
  Description of Artificial Sequence: Synthetic polypeptide
  XENP022722 1C11_H2L1_Fab Light Chain
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 112 aa, Artificial Sequence
  Description of Artificial Sequence: Synthetic polypeptide
  VL of XENP022722
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIK

SEQ ID NO: 18 - protein, 16 aa, Artificial Sequence
  Description of Artificial Sequence: Synthetic peptide
  XENP022722 vlCDR1
RSSQSIVHSNGNTYLE

SEQ ID NO: 19 - protein, 7 aa, Artificial Sequence
  Description of Artificial Sequence: Synthetic peptide
  XENP022722 vlCDR2
KVSNRFS

SEQ ID NO: 20 - protein, 9 aa, Artificial Sequence
  Description of Artificial Sequence: Synthetic peptide
  XENP022722 vlCDR3
FQGSHVPNT

SEQ ID NO: 21 - protein, 222 aa, Artificial Sequence; identical to SEQ ID NO: 11
  Description of Artificial Sequence: Synthetic polypeptide
  XENP022723 1C11_H2L2_Fab Heavy Chain

SEQ ID NO: 22 - protein, 117 aa, Artificial Sequence; identical to SEQ ID NO: 12
  Description of Artificial Sequence: Synthetic polypeptide
  VH of XENP022723

SEQ ID NO: 23 - protein, 5 aa, Artificial Sequence
  Description of Artificial Sequence: Synthetic peptide
  XENP022723 vhCDR1
HYGMN

SEQ ID NO: 24 - protein, 17 aa, Artificial Sequence
  Description of Artificial Sequence: Synthetic peptide
  XENP022723 vhCDR2
WINTYTGEPTYADSVKG

SEQ ID NO: 25 - protein, 8 aa, Artificial Sequence
  Description of Artificial Sequence: Synthetic peptide
  XENP022723 vhCDR3
DYYGSSPY

SEQ ID NO: 26 - protein, 219 aa, Artificial Sequence
  Description of Artificial Sequence: Synthetic polypeptide
  XENP022723 1C11_H2L2_Fab Light Chain
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 112 aa, Artificial Sequence
  Description of Artificial Sequence: Synthetic polypeptide
  VL of XENP022723
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIK

SEQ ID NO: 28 - protein, 16 aa, Artificial Sequence
  Description of Artificial Sequence: Synthetic peptide
  XENP022723 vlCDR1
RSSQSIVHSNGNTYLE

SEQ ID NO: 29 - protein, 7 aa, Artificial Sequence
  Description of Artificial Sequence: Synthetic peptide
  XENP022723 vlCDR2
KVSNRFS

SEQ ID NO: 30 - protein, 9 aa, Artificial Sequence
  Description of Artificial Sequence: Synthetic peptide
  XENP022723 vlCDR3
FQGSHVPNT

SEQ ID NO: 31 - protein, 222 aa, Artificial Sequence
  Description of Artificial Sequence: Synthetic polypeptide
  XENP022724 1C11_H3L3_Fab Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32 - protein, 117 aa, Artificial Sequence
  Description of Artificial Sequence: Synthetic polypeptide
  VH of XENP022724
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33 - protein, 5 aa, Artificial Sequence
  Description of Artificial Sequence: Synthetic peptide
  XENP022724 vhCDR1
HYGMN

SEQ ID NO: 34 - protein, 17 aa, Artificial Sequence
  Description of Artificial Sequence: Synthetic peptide
  XENP022724 vhCDR2
WINTYTGEPTYADGFTG

SEQ ID NO: 35 - protein, 8 aa, Artificial Sequence
  Description of Artificial Sequence: Synthetic peptide
  XENP022724 vhCDR3
DYYGSSPY

SEQ ID NO: 36 - protein, 219 aa, Artificial Sequence; identical to SEQ ID NO: 6
  Description of Artificial Sequence: Synthetic polypeptide
  XENP022724 1C11_H3L3_Fab Light Chain

SEQ ID NO: 37 - protein, 112 aa, Artificial Sequence; identical to SEQ ID NO: 7
  Description of Artificial Sequence: Synthetic polypeptide
  VL of XENP022724

SEQ ID NO: 38 - protein, 16 aa, Artificial Sequence
  Description of Artificial Sequence: Synthetic peptide
  XENP022724 vlCDR1
KSSQSIVHSNGNTYLE

SEQ ID NO: 39 - protein, 7 aa, Artificial Sequence
  Description of Artificial Sequence: Synthetic peptide
  XENP022724 vlCDR2
KVSNRFS

SEQ ID NO: 40 - protein, 9 aa, Artificial Sequence
  Description of Artificial Sequence: Synthetic peptide
  XENP022724 vlCDR3
FQGSHVPNT

SEQ ID NO: 41 - protein, 222 aa, Artificial Sequence
  Description of Artificial Sequence: Synthetic polypeptide
  XENP022725 1C11_H0L0_Fab Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 42 - protein, 117 aa, Artificial Sequence
  Description of Artificial Sequence: Synthetic polypeptide
  VH of XENP022725
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 43 - protein, 5 aa, Artificial Sequence
  Description of Artificial Sequence: Synthetic peptide
  XENP022725 vhCDR1
HYGMN

SEQ ID NO: 44 - protein, 17 aa, Artificial Sequence
  Description of Artificial Sequence: Synthetic peptide
  XENP022725 vhCDR2
WINTYTGEPTYADDFKG

SEQ ID NO: 45 - protein, 8 aa, Artificial Sequence
  Description of Artificial Sequence: Synthetic peptide
  XENP022725 vhCDR3
DYYGSSPY

SEQ ID NO: 46 - protein, 219 aa, Artificial Sequence
  Description of Artificial Sequence: Synthetic polypeptide
  XENP022725 1C11_H0L0_Fab Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 112 aa, Artificial Sequence
  Description of Artificial Sequence: Synthetic polypeptide
  VL of XENP022725
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 48 - protein, 16 aa, Artificial Sequence
  Description of Artificial Sequence: Synthetic peptide
  XENP022725 vlCDR1
RSSQSIVHSNGNTYLE

SEQ ID NO: 49 - protein, 7 aa, Artificial Sequence
  Description of Artificial Sequence: Synthetic peptide
  XENP022725 vlCDR2
KVSNRFS

SEQ ID NO: 50 - protein, 9 aa, Artificial Sequence
  Description of Artificial Sequence: Synthetic peptide
  XENP022725 vlCDR3
FQGSHVPNT

SEQ ID NO: 51 - protein, 222 aa, Artificial Sequence; identical to SEQ ID NO: 31
  Description of Artificial Sequence: Synthetic polypeptide
  XENP022991 1C11_H3L1_Fab Heavy Chain

SEQ ID NO: 52 - protein, 117 aa, Artificial Sequence; identical to SEQ ID NO: 32
  Description of Artificial Sequence: Synthetic polypeptide
  VH of XENP022991

SEQ ID NO: 53 - protein, 5 aa, Artificial Sequence
  Description of Artificial Sequence: Synthetic peptide
  XENP022991 vhCDR1
HYGMN

SEQ ID NO: 54 - protein, 17 aa, Artificial Sequence
  Description of Artificial Sequence: Synthetic peptide
  XENP022991 vhCDR2
WINTYTGEPTYADGFTG

SEQ ID NO: 55 - protein, 8 aa, Artificial Sequence
  Description of Artificial Sequence: Synthetic peptide
  XENP022991 vhCDR3
DYYGSSPY

SEQ ID NO: 56 - protein, 219 aa, Artificial Sequence; identical to SEQ ID NO: 16
  Description of Artificial Sequence: Synthetic polypeptide
  XENP022991 1C11_H3L1_Fab Light Chain

SEQ ID NO: 57 - protein, 112 aa, Artificial Sequence; identical to SEQ ID NO: 17
  Description of Artificial Sequence: Synthetic polypeptide
  VL of XENP022991

SEQ ID NO: 58 - protein, 16 aa, Artificial Sequence
  Description of Artificial Sequence: Synthetic peptide
  XENP022991 vlCDR1
RSSQSIVHSNGNTYLE

SEQ ID NO: 59 - protein, 7 aa, Artificial Sequence
  Description of Artificial Sequence: Synthetic peptide
  XENP022991 vlCDR2
KVSNRFS

SEQ ID NO: 60 - protein, 9 aa, Artificial Sequence
  Description of Artificial Sequence: Synthetic peptide
  XENP022991 vlCDR3
FQGSHVPNT

SEQ ID NO: 61 - protein, 222 aa, Artificial Sequence; identical to SEQ ID NO: 31
  Description of Artificial Sequence: Synthetic polypeptide
  XENP022992 1C11_H3L2_Fab Heavy Chain

SEQ ID NO: 62 - protein, 117 aa, Artificial Sequence; identical to SEQ ID NO: 32
  Description of Artificial Sequence: Synthetic polypeptide
  VH of XENP022992

SEQ ID NO: 63 - protein, 5 aa, Artificial Sequence
  Description of Artificial Sequence: Synthetic peptide
  XENP022992 vhCDR1
HYGMN

SEQ ID NO: 64 - protein, 17 aa, Artificial Sequence
  Description of Artificial Sequence: Synthetic peptide
  XENP022992 vhCDR2
WINTYTGEPTYADGFTG

SEQ ID NO: 65 - protein, 8 aa, Artificial Sequence
  Description of Artificial Sequence: Synthetic peptide
  XENP022992 vhCDR3
DYYGSSPY

SEQ ID NO: 66 - protein, 219 aa, Artificial Sequence; identical to SEQ ID NO: 26
  Description of Artificial Sequence: Synthetic polypeptide
  XENP022992 1C11_H3L2_Fab Light Chain

SEQ ID NO: 67 - protein, 112 aa, Artificial Sequence; identical to SEQ ID NO: 27
  Description of Artificial Sequence: Synthetic polypeptide
  VL of XENP022992

SEQ ID NO: 68 - protein, 16 aa, Artificial Sequence
  Description of Artificial Sequence: Synthetic peptide
  XENP022992 vlCDR1
RSSQSIVHSNGNTYLE

SEQ ID NO: 69 - protein, 7 aa, Artificial Sequence
  Description of Artificial Sequence: Synthetic peptide
  XENP022992 vlCDR2
KVSNRFS

SEQ ID NO: 70 - protein, 9 aa, Artificial Sequence
  Description of Artificial Sequence: Synthetic peptide
  XENP022992 vlCDR3
FQGSHVPNT

SEQ ID NO: 71 - protein, 251 aa, Artificial Sequence
  Description of Artificial Sequence: Synthetic polypeptide
  XENP023574 1C11_L1H3_scFv
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 72 - protein, 112 aa, Artificial Sequence; identical to SEQ ID NO: 17
  Description of Artificial Sequence: Synthetic polypeptide
  VH of XENP023574

SEQ ID NO: 73 - protein, 119 aa, Artificial Sequence
  Description of Artificial Sequence: Synthetic polypeptide
  VL of XENP023574
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 74 - protein, 16 aa, Artificial Sequence
  Description of Artificial Sequence: Synthetic peptide
  XENP023574 vhCDR1
RSSQSIVHSNGNTYLE

SEQ ID NO: 75 - protein, 7 aa, Artificial Sequence
  Description of Artificial Sequence: Synthetic peptide
  XENP023574 vhCDR2
KVSNRFS

SEQ ID NO: 76 - protein, 9 aa, Artificial Sequence
  Description of Artificial Sequence: Synthetic peptide
  XENP023574 vhCDR3
FQGSHVPNT

SEQ ID NO: 77 - protein, 5 aa, Artificial Sequence
  Description of Artificial Sequence: Synthetic peptide
  XENP023574 vlCDR1
HYGMN

SEQ ID NO: 78 - protein, 17 aa, Artificial Sequence
  Description of Artificial Sequence: Synthetic peptide
  XENP023574 vlCDR2
WINTYTGEPTYADGFTG

SEQ ID NO: 79 - protein, 8 aa, Artificial Sequence
  Description of Artificial Sequence: Synthetic peptide
  XENP023574 vlCDR3
DYYGSSPY

SEQ ID NO: 80 - protein, 251 aa, Artificial Sequence
  Description of Artificial Sequence: Synthetic polypeptide
  XENP023575 1C11_L2H3_scFv
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 81 - protein, 112 aa, Artificial Sequence; identical to SEQ ID NO: 27
  Description of Artificial Sequence: Synthetic polypeptide
  VH of XENP023575

SEQ ID NO: 82 - protein, 119 aa, Artificial Sequence; identical to SEQ ID NO: 73
  Description of Artificial Sequence: Synthetic polypeptide
  VL of XENP023575

SEQ ID NO: 83 - protein, 16 aa, Artificial Sequence
  Description of Artificial Sequence: Synthetic peptide
  XENP023575 vhCDR1
RSSQSIVHSNGNTYLE

SEQ ID NO: 84 - protein, 7 aa, Artificial Sequence
  Description of Artificial Sequence: Synthetic peptide
  XENP023575 vhCDR2
KVSNRFS

SEQ ID NO: 85 - protein, 9 aa, Artificial Sequence
  Description of Artificial Sequence: Synthetic peptide
  XENP023575 vhCDR3
FQGSHVPNT

SEQ ID NO: 86 - protein, 5 aa, Artificial Sequence
  Description of Artificial Sequence: Synthetic peptide
  XENP023575 vlCDR1
HYGMN

SEQ ID NO: 87 - protein, 17 aa, Artificial Sequence
  Description of Artificial Sequence: Synthetic peptide
  XENP023575 vlCDR2
WINTYTGEPTYADGFTG

SEQ ID NO: 88 - protein, 8 aa, Artificial Sequence
  Description of Artificial Sequence: Synthetic peptide
  XENP023575 vlCDR3
DYYGSSPY

SEQ ID NO: 89 - protein, 251 aa, Artificial Sequence
  Description of Artificial Sequence: Synthetic polypeptide
  XENP023576 1C11_L3H3_scFv
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 90 - protein, 112 aa, Artificial Sequence; identical to SEQ ID NO: 7
  Description of Artificial Sequence: Synthetic polypeptide
  VH of XENP023576

SEQ ID NO: 91 - protein, 119 aa, Artificial Sequence; identical to SEQ ID NO: 73
  Description of Artificial Sequence: Synthetic polypeptide
  VL of XENP023576

SEQ ID NO: 92 - protein, 16 aa, Artificial Sequence
  Description of Artificial Sequence: Synthetic peptide
  XENP023576 vhCDR1
KSSQSIVHSNGNTYLE

SEQ ID NO: 93 - protein, 7 aa, Artificial Sequence
  Description of Artificial Sequence: Synthetic peptide
  XENP023576 vhCDR2
KVSNRFS

SEQ ID NO: 94 - protein, 9 aa, Artificial Sequence
  Description of Artificial Sequence: Synthetic peptide
  XENP023576 vhCDR3
FQGSHVPNT

SEQ ID NO: 95 - protein, 5 aa, Artificial Sequence
  Description of Artificial Sequence: Synthetic peptide
  XENP023576 vlCDR1
HYGMN

SEQ ID NO: 96 - protein, 17 aa, Artificial Sequence
  Description of Artificial Sequence: Synthetic peptide
  XENP023576 vlCDR2
WINTYTGEPTYADGFTG

SEQ ID NO: 97 - protein, 8 aa, Artificial Sequence
  Description of Artificial Sequence: Synthetic peptide
  XENP023576 vlCDR3
DYYGSSPY

SEQ ID NO: 98 - protein, 251 aa, Artificial Sequence
  Description of Artificial Sequence: Synthetic polypeptide
  XENP023577 1C11_H3_L3.1_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 99 - protein, 117 aa, Artificial Sequence; identical to SEQ ID NO: 32
  Description of Artificial Sequence: Synthetic polypeptide
  VH of XENP023577

SEQ ID NO: 100 - protein, 114 aa, Artificial Sequence
  Description of Artificial Sequence: Synthetic polypeptide
  VL of XENP023577
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 101 - protein, 5 aa, Artificial Sequence
  Description of Artificial Sequence: Synthetic peptide
  XENP023577 vhCDR1
HYGMN

SEQ ID NO: 102 - protein, 17 aa, Artificial Sequence
  Description of Artificial Sequence: Synthetic peptide
  XENP023577 vhCDR2
WINTYTGEPTYADGFTG

SEQ ID NO: 103 - protein, 8 aa, Artificial Sequence
  Description of Artificial Sequence: Synthetic peptide
  XENP023577 vhCDR3
DYYGSSPY

SEQ ID NO: 104 - protein, 16 aa, Artificial Sequence
  Description of Artificial Sequence: Synthetic peptide
  XENP023577 vlCDR1
KSSQSIVHSNGNTYLE

SEQ ID NO: 105 - protein, 7 aa, Artificial Sequence
  Description of Artificial Sequence: Synthetic peptide
  XENP023577 vlCDR2
KVSNRFS

SEQ ID NO: 106 - protein, 9 aa, Artificial Sequence
  Description of Artificial Sequence: Synthetic peptide
  XENP023577 vlCDR3
FQGSHVPNT

SEQ ID NO: 107 - protein, 251 aa, Artificial Sequence
  Description of Artificial Sequence: Synthetic polypeptide
  XENP023578 1C11_H3_L3.2_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 108 - protein, 117 aa, Artificial Sequence; identical to SEQ ID NO: 32
  Description of Artificial Sequence: Synthetic polypeptide
  VH of XENP023578

SEQ ID NO: 109 - protein, 114 aa, Artificial Sequence
  Description of Artificial Sequence: Synthetic polypeptide
  VL of XENP023578
DLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 110 - protein, 5 aa, Artificial Sequence
  Description of Artificial Sequence: Synthetic peptide
  XENP023578 vhCDR1
HYGMN

SEQ ID NO: 111 - protein, 17 aa, Artificial Sequence
  Description of Artificial Sequence: Synthetic peptide
  XENP023578 vhCDR2
WINTYTGEPTYADGFTG

SEQ ID NO: 112 - protein, 8 aa, Artificial Sequence
  Description of Artificial Sequence: Synthetic peptide
  XENP023578 vhCDR3
DYYGSSPY

SEQ ID NO: 113 - protein, 16 aa, Artificial Sequence
  Description of Artificial Sequence: Synthetic peptide
  XENP023578 vlCDR1
KSSQSIVHSNGNTYLE

SEQ ID NO: 114 - protein, 7 aa, Artificial Sequence
  Description of Artificial Sequence: Synthetic peptide
  XENP023578 vlCDR2
KVSNRFS

SEQ ID NO: 115 - protein, 9 aa, Artificial Sequence
  Description of Artificial Sequence: Synthetic peptide
  XENP023578 vlCDR3
FQGSHVPNT

SEQ ID NO: 116 - protein, 251 aa, Artificial Sequence
  Description of Artificial Sequence: Synthetic polypeptide
  XENP023579 1C11_H3_L3.3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 117 - protein, 117 aa, Artificial Sequence; identical to SEQ ID NO: 32
  Description of Artificial Sequence: Synthetic polypeptide
  VH of XENP023579

SEQ ID NO: 118 - protein, 114 aa, Artificial Sequence
  Description of Artificial Sequence: Synthetic polypeptide
  VL of XENP023579
DVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 119 - protein, 5 aa, Artificial Sequence
  Description of Artificial Sequence: Synthetic peptide
  XENP023579 vhCDR1
HYGMN

SEQ ID NO: 120 - protein, 17 aa, Artificial Sequence
  Description of Artificial Sequence: Synthetic peptide
  XENP023579 vhCDR2
WINTYTGEPTYADGFTG

SEQ ID NO: 121 - protein, 8 aa, Artificial Sequence
  Description of Artificial Sequence: Synthetic peptide
  XENP023579 vhCDR3
DYYGSSPY

SEQ ID NO: 122 - protein, 16 aa, Artificial Sequence
  Description of Artificial Sequence: Synthetic peptide
  XENP023579 vlCDR1
KSSQSIVHSNGNTYLE

SEQ ID NO: 123 - protein, 7 aa, Artificial Sequence
  Description of Artificial Sequence: Synthetic peptide
  XENP023579 vlCDR2
KVSNRFS

SEQ ID NO: 124 - protein, 9 aa, Artificial Sequence
  Description of Artificial Sequence: Synthetic peptide
  XENP023579 vlCDR3
FQGSHVPNT

SEQ ID NO: 125 - protein, 251 aa, Artificial Sequence
  Description of Artificial Sequence: Synthetic polypeptide
  XENP023580 1C11_H3_L3.4_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 126 - protein, 117 aa, Artificial Sequence; identical to SEQ ID NO: 32
  Description of Artificial Sequence: Synthetic polypeptide
  VH of XENP023580

SEQ ID NO: 127 - protein, 114 aa, Artificial Sequence
  Description of Artificial Sequence: Synthetic polypeptide
  VL of XENP023580
DVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 128 - protein, 5 aa, Artificial Sequence
  Description of Artificial Sequence: Synthetic peptide
  XENP023580 vhCDR1
HYGMN

SEQ ID NO: 129 - protein, 17 aa, Artificial Sequence
  Description of Artificial Sequence: Synthetic peptide
  XENP023580 vhCDR2
WINTYTGEPTYADGFTG

SEQ ID NO: 130 - protein, 8 aa, Artificial Sequence
  Description of Artificial Sequence: Synthetic peptide
  XENP023580 vhCDR3
DYYGSSPY

SEQ ID NO: 131 - protein, 16 aa, Artificial Sequence
  Description of Artificial Sequence: Synthetic peptide
  XENP023580 vlCDR1
KSSQSIVHSNGNTYLE

SEQ ID NO: 132 - protein, 7 aa, Artificial Sequence
  Description of Artificial Sequence: Synthetic peptide
  XENP023580 vlCDR2
KVSNRFS

SEQ ID NO: 133 - protein, 9 aa, Artificial Sequence
  Description of Artificial Sequence: Synthetic peptide
  XENP023580 vlCDR3
FQGSHVPNT

SEQ ID NO: 134 - protein, 251 aa, Artificial Sequence
  Description of Artificial Sequence: Synthetic polypeptide
  XENP023581 1C11_H3_L3.5_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 135 - protein, 117 aa, Artificial Sequence; identical to SEQ ID NO: 32
  Description of Artificial Sequence: Synthetic polypeptide
  VH of XENP023581

SEQ ID NO: 136 - protein, 114 aa, Artificial Sequence
  Description of Artificial Sequence: Synthetic polypeptide
  VL of XENP023581
DVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 137 - protein, 5 aa, Artificial Sequence
  Description of Artificial Sequence: Synthetic peptide
  XENP023581 vhCDR1
HYGMN

SEQ ID NO: 138 - protein, 17 aa, Artificial Sequence
  Description of Artificial Sequence: Synthetic peptide
  XENP023581 vhCDR2
WINTYTGEPTYADGFTG

SEQ ID NO: 139 - protein, 8 aa, Artificial Sequence
  Description of Artificial Sequence: Synthetic peptide
  XENP023581 vhCDR3
DYYGSSPY

SEQ ID NO: 140 - protein, 16 aa, Artificial Sequence
  Description of Artificial Sequence: Synthetic peptide
  XENP023581 vlCDR1
KSSQSIVHSNGNTYLE

SEQ ID NO: 141 - protein, 7 aa, Artificial Sequence
  Description of Artificial Sequence: Synthetic peptide
  XENP023581 vlCDR2
KVSNRFS

SEQ ID NO: 142 - protein, 9 aa, Artificial Sequence
  Description of Artificial Sequence: Synthetic peptide
  XENP023581 vlCDR3
FQGSHVPNT

SEQ ID NO: 143 - protein, 251 aa, Artificial Sequence
  Description of Artificial Sequence: Synthetic polypeptide
  XENP023582 1C11_H3_L3.6_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 144 - protein, 117 aa, Artificial Sequence; identical to SEQ ID NO: 32
  Description of Artificial Sequence: Synthetic polypeptide
  VH of XENP023582

SEQ ID NO: 145 - protein, 114 aa, Artificial Sequence
  Description of Artificial Sequence: Synthetic polypeptide
  VL of XENP023582
DVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 146 - protein, 5 aa, Artificial Sequence
  Description of Artificial Sequence: Synthetic peptide
  XENP023582 vhCDR1
HYGMN

SEQ ID NO: 147 - protein, 17 aa, Artificial Sequence
  Description of Artificial Sequence: Synthetic peptide
  XENP023582 vhCDR2
WINTYTGEPTYADGFTG

SEQ ID NO: 148 - protein, 8 aa, Artificial Sequence
  Description of Artificial Sequence: Synthetic peptide
  XENP023582 vhCDR3
DYYGSSPY

SEQ ID NO: 149 - protein, 16 aa, Artificial Sequence
  Description of Artificial Sequence: Synthetic peptide
  XENP023582 vlCDR1
KSSQSIVHSNGNTYLE

SEQ ID NO: 150 - protein, 7 aa, Artificial Sequence
  Description of Artificial Sequence: Synthetic peptide
  XENP023582 vlCDR2
KVSNRFS

SEQ ID NO: 151 - protein, 9 aa, Artificial Sequence
  Description of Artificial Sequence: Synthetic peptide
  XENP023582 vlCDR3
FQGSHVPNT

SEQ ID NO: 152 - protein, 251 aa, Artificial Sequence
  Description of Artificial Sequence: Synthetic polypeptide
  XENP023583 1C11_H3_L3.7_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 153 - protein, 117 aa, Artificial Sequence; identical to SEQ ID NO: 32
  Description of Artificial Sequence: Synthetic polypeptide
  VH of XENP023583

SEQ ID NO: 154 - protein, 114 aa, Artificial Sequence
  Description of Artificial Sequence: Synthetic polypeptide
  VL of XENP023583
DIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 155 - protein, 5 aa, Artificial Sequence
  Description of Artificial Sequence: Synthetic peptide
  XENP023583 vhCDR1
HYGMN

SEQ ID NO: 156 - protein, 17 aa, Artificial Sequence
  Description of Artificial Sequence: Synthetic peptide
  XENP023583 vhCDR2
WINTYTGEPTYADGFTG

SEQ ID NO: 157 - protein, 8 aa, Artificial Sequence
  Description of Artificial Sequence: Synthetic peptide
  XENP023583 vhCDR3
DYYGSSPY

SEQ ID NO: 158 - protein, 16 aa, Artificial Sequence
  Description of Artificial Sequence: Synthetic peptide
  XENP023583 vlCDR1
KSSQSIVHSNGNTYLE

SEQ ID NO: 159 - protein, 7 aa, Artificial Sequence
  Description of Artificial Sequence: Synthetic peptide
  XENP023583 vlCDR2
KVSNRFS

SEQ ID NO: 160 - protein, 9 aa, Artificial Sequence
  Description of Artificial Sequence: Synthetic peptide
  XENP023583 vlCDR3
FQGSHVPNT

SEQ ID NO: 161 - protein, 251 aa, Artificial Sequence
  Description of Artificial Sequence: Synthetic polypeptide
  XENP023584 1C11_H3_L3.9_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 162 - protein, 117 aa, Artificial Sequence; identical to SEQ ID NO: 32
  Description of Artificial Sequence: Synthetic polypeptide
  VH of XENP023584

SEQ ID NO: 163 - protein, 114 aa, Artificial Sequence
  Description of Artificial Sequence: Synthetic polypeptide
  VL of XENP023584
DVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 164 - protein, 5 aa, Artificial Sequence
  Description of Artificial Sequence: Synthetic peptide
  XENP023584 vhCDR1
HYGMN

SEQ ID NO: 165 - protein, 17 aa, Artificial Sequence
  Description of Artificial Sequence: Synthetic peptide
  XENP023584 vhCDR2
WINTYTGEPTYADGFTG

SEQ ID NO: 166 - protein, 8 aa, Artificial Sequence
  Description of Artificial Sequence: Synthetic peptide
  XENP023584 vhCDR3
DYYGSSPY

SEQ ID NO: 167 - protein, 16 aa, Artificial Sequence
  Description of Artificial Sequence: Synthetic peptide
  XENP023584 vlCDR1
KSSQSIVHSNGNTYLE

SEQ ID NO: 168 - protein, 7 aa, Artificial Sequence
  Description of Artificial Sequence: Synthetic peptide
  XENP023584 vlCDR2
KVSNRFS

SEQ ID NO: 169 - protein, 9 aa, Artificial Sequence
  Description of Artificial Sequence: Synthetic peptide
  XENP023584 vlCDR3
FQGSHVPNT

SEQ ID NO: 170 - protein, 251 aa, Artificial Sequence
  Description of Artificial Sequence: Synthetic polypeptide
  XENP023585 1C11_H3_L3.10_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 171 - protein, 117 aa, Artificial Sequence; identical to SEQ ID NO: 32
  Description of Artificial Sequence: Synthetic polypeptide
  VH of XENP023585

SEQ ID NO: 172 - protein, 114 aa, Artificial Sequence
  Description of Artificial Sequence: Synthetic polypeptide
  VL of XENP023585
DVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 173 - protein, 5 aa, Artificial Sequence
  Description of Artificial Sequence: Synthetic peptide
  XENP023585 vhCDR1
HYGMN

SEQ ID NO: 174 - protein, 17 aa, Artificial Sequence
  Description of Artificial Sequence: Synthetic peptide
  XENP023585 vhCDR2
WINTYTGEPTYADGFTG

SEQ ID NO: 175 - protein, 8 aa, Artificial Sequence
  Description of Artificial Sequence: Synthetic peptide
  XENP023585 vhCDR3
DYYGSSPY

SEQ ID NO: 176 - protein, 16 aa, Artificial Sequence
  Description of Artificial Sequence: Synthetic peptide
  XENP023585 vlCDR1
KSSQSIVHSNGNTYLE

SEQ ID NO: 177 - protein, 7 aa, Artificial Sequence
  Description of Artificial Sequence: Synthetic peptide
  XENP023585 vlCDR2
KVSNRFS

SEQ ID NO: 178 - protein, 9 aa, Artificial Sequence
  Description of Artificial Sequence: Synthetic peptide
  XENP023585 vlCDR3
FQGSHVPNT

SEQ ID NO: 179 - protein, 251 aa, Artificial Sequence
  Description of Artificial Sequence: Synthetic polypeptide
  XENP023586 1C11_H3_L3.11_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 180 - protein, 117 aa, Artificial Sequence; identical to SEQ ID NO: 32
  Description of Artificial Sequence: Synthetic polypeptide
  VH of XENP023586

SEQ ID NO: 181 - protein, 114 aa, Artificial Sequence
  Description of Artificial Sequence: Synthetic polypeptide
  VL of XENP023586
DVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 182 - protein, 5 aa, Artificial Sequence
  Description of Artificial Sequence: Synthetic peptide
  XENP023586 vhCDR1
HYGMN

SEQ ID NO: 183 - protein, 17 aa, Artificial Sequence
  Description of Artificial Sequence: Synthetic peptide
  XENP023586 vhCDR2
WINTYTGEPTYADGFTG

SEQ ID NO: 184 - protein, 8 aa, Artificial Sequence
  Description of Artificial Sequence: Synthetic peptide
  XENP023586 vhCDR3
DYYGSSPY

SEQ ID NO: 185 - protein, 16 aa, Artificial Sequence
  Description of Artificial Sequence: Synthetic peptide
  XENP023586 vlCDR1
KSSQSIVHSNGNTYLE

SEQ ID NO: 186 - protein, 7 aa, Artificial Sequence
  Description of Artificial Sequence: Synthetic peptide
  XENP023586 vlCDR2
KVSNRFS

SEQ ID NO: 187 - protein, 9 aa, Artificial Sequence
  Description of Artificial Sequence: Synthetic peptide
  XENP023586 vlCDR3
FQGSHVPNT

SEQ ID NO: 188 - protein, 251 aa, Artificial Sequence
  Description of Artificial Sequence: Synthetic polypeptide
  XENP023587 1C11_H3_L3.12_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 189 - protein, 117 aa, Artificial Sequence; identical to SEQ ID NO: 32
  Description of Artificial Sequence: Synthetic polypeptide
  VH of XENP023587

SEQ ID NO: 190 - protein, 114 aa, Artificial Sequence
  Description of Artificial Sequence: Synthetic polypeptide
  VL of XENP023587
DVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 191 - protein, 5 aa, Artificial Sequence
  Description of Artificial Sequence: Synthetic peptide
  XENP023587 vhCDR1
HYGMN

SEQ ID NO: 192 - protein, 17 aa, Artificial Sequence
  Description of Artificial Sequence: Synthetic peptide
  XENP023587 vhCDR2
WINTYTGEPTYADGFTG

SEQ ID NO: 193 - protein, 8 aa, Artificial Sequence
  Description of Artificial Sequence: Synthetic peptide
  XENP023587 vhCDR3
DYYGSSPY

SEQ ID NO: 194 - protein, 16 aa, Artificial Sequence
  Description of Artificial Sequence: Synthetic peptide
  XENP023587 vlCDR1
KSSQSIVHSNGNTYLE

SEQ ID NO: 195 - protein, 7 aa, Artificial Sequence
  Description of Artificial Sequence: Synthetic peptide
  XENP023587 vlCDR2
KVSNRFS

SEQ ID NO: 196 - protein, 9 aa, Artificial Sequence
  Description of Artificial Sequence: Synthetic peptide
  XENP023587 vlCDR3
FQGSHVPNT

SEQ ID NO: 197 - protein, 251 aa, Artificial Sequence
  Description of Artificial Sequence: Synthetic polypeptide
  XENP023588 1C11_H3_L3.14_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 198 - protein, 117 aa, Artificial Sequence; identical to SEQ ID NO: 32
  Description of Artificial Sequence: Synthetic polypeptide
  VH of XENP023588

SEQ ID NO: 199 - protein, 114 aa, Artificial Sequence
  Description of Artificial Sequence: Synthetic polypeptide
  VL of XENP023588
DVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 200 - protein, 5 aa, Artificial Sequence
  Description of Artificial Sequence: Synthetic peptide
  XENP023588 vhCDR1
HYGMN

SEQ ID NO: 201 - protein, 17 aa, Artificial Sequence
  Description of Artificial Sequence: Synthetic peptide
  XENP023588 vhCDR2
WINTYTGEPTYADGFTG

SEQ ID NO: 202 - protein, 8 aa, Artificial Sequence
  Description of Artificial Sequence: Synthetic peptide
  XENP023588 vhCDR3
DYYGSSPY

SEQ ID NO: 203 - protein, 16 aa, Artificial Sequence
  Description of Artificial Sequence: Synthetic peptide
  XENP023588 vlCDR1
KSSQSIVHSNGNTYLE

SEQ ID NO: 204 - protein, 7 aa, Artificial Sequence
  Description of Artificial Sequence: Synthetic peptide
  XENP023588 vlCDR2
KVSNRFS

SEQ ID NO: 205 - protein, 9 aa, Artificial Sequence
  Description of Artificial Sequence: Synthetic peptide
  XENP023588 vlCDR3
FQGSHVPNT

SEQ ID NO: 206 - protein, 251 aa, Artificial Sequence
  Description of Artificial Sequence: Synthetic polypeptide
  XENP023589 1C11_H3_L3.15_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 207 - protein, 117 aa, Artificial Sequence; identical to SEQ ID NO: 32
  Description of Artificial Sequence: Synthetic polypeptide
  VH of XENP023589

SEQ ID NO: 208 - protein, 114 aa, Artificial Sequence
  Description of Artificial Sequence: Synthetic polypeptide
  VL of XENP023589
DVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 209 - protein, 5 aa, Artificial Sequence
  Description of Artificial Sequence: Synthetic peptide
  XENP023589 vhCDR1
HYGMN

SEQ ID NO: 210 - protein, 17 aa, Artificial Sequence
  Description of Artificial Sequence: Synthetic peptide
  XENP023589 vhCDR2
WINTYTGEPTYADGFTG

SEQ ID NO: 211 - protein, 8 aa, Artificial Sequence
  Description of Artificial Sequence: Synthetic peptide
  XENP023589 vhCDR3
DYYGSSPY

SEQ ID NO: 212 - protein, 16 aa, Artificial Sequence
  Description of Artificial Sequence: Synthetic peptide
  XENP023589 vlCDR1
KSSQSIVHSNGNTYLE

SEQ ID NO: 213 - protein, 7 aa, Artificial Sequence
  Description of Artificial Sequence: Synthetic peptide
  XENP023589 vlCDR2
KVSNRFS

SEQ ID NO: 214 - protein, 9 aa, Artificial Sequence
  Description of Artificial Sequence: Synthetic peptide
  XENP023589 vlCDR3
FQGSHVPNT

SEQ ID NO: 215 - protein, 251 aa, Artificial Sequence
  Description of Artificial Sequence: Synthetic polypeptide
  XENP023590 1C11_H3_L3.16_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 216 - protein, 117 aa, Artificial Sequence; identical to SEQ ID NO: 32
  Description of Artificial Sequence: Synthetic polypeptide
  VH of XENP023590

SEQ ID NO: 217 - protein, 114 aa, Artificial Sequence
  Description of Artificial Sequence: Synthetic polypeptide
  VL of XENP023590
DVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 218 - protein, 5 aa, Artificial Sequence
  Description of Artificial Sequence: Synthetic peptide
  XENP023590 vhCDR1
HYGMN

SEQ ID NO: 219 - protein, 17 aa, Artificial Sequence
  Description of Artificial Sequence: Synthetic peptide
  XENP023590 vhCDR2
WINTYTGEPTYADGFTG

SEQ ID NO: 220 - protein, 8 aa, Artificial Sequence
  Description of Artificial Sequence: Synthetic peptide
  XENP023590 vhCDR3
DYYGSSPY

SEQ ID NO: 221 - protein, 16 aa, Artificial Sequence
  Description of Artificial Sequence: Synthetic peptide
  XENP023590 vlCDR1
KSSQSIVHSNGNTYLE

SEQ ID NO: 222 - protein, 7 aa, Artificial Sequence
  Description of Artificial Sequence: Synthetic peptide
  XENP023590 vlCDR2
KVSNRFS

SEQ ID NO: 223 - protein, 9 aa, Artificial Sequence
  Description of Artificial Sequence: Synthetic peptide
  XENP023590 vlCDR3
FQGSHVPNT

SEQ ID NO: 224 - protein, 251 aa, Artificial Sequence
  Description of Artificial Sequence: Synthetic polypeptide
  XENP023591 1C11_H3_L3.17_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 225 - protein, 117 aa, Artificial Sequence; identical to SEQ ID NO: 32
  Description of Artificial Sequence: Synthetic polypeptide
  VH of XENP023591

SEQ ID NO: 226 - protein, 114 aa, Artificial Sequence
  Description of Artificial Sequence: Synthetic polypeptide
  VL of XENP023591
DVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 227 - protein, 5 aa, Artificial Sequence
  Description of Artificial Sequence: Synthetic peptide
  XENP023591 vhCDR1
HYGMN

SEQ ID NO: 228 - protein, 17 aa, Artificial Sequence
  Description of Artificial Sequence: Synthetic peptide
  XENP023591 vhCDR2
WINTYTGEPTYADGFTG

SEQ ID NO: 229 - protein, 8 aa, Artificial Sequence
  Description of Artificial Sequence: Synthetic peptide
  XENP023591 vhCDR3
DYYGSSPY

SEQ ID NO: 230 - protein, 16 aa, Artificial Sequence
  Description of Artificial Sequence: Synthetic peptide
  XENP023591 vlCDR1
KSSQSIVHSNGNTYLE

SEQ ID NO: 231 - protein, 7 aa, Artificial Sequence
  Description of Artificial Sequence: Synthetic peptide
  XENP023591 vlCDR2
KVSNRFS

SEQ ID NO: 232 - protein, 9 aa, Artificial Sequence
  Description of Artificial Sequence: Synthetic peptide
  XENP023591 vlCDR3
FQGSHVPNT

SEQ ID NO: 233 - protein, 251 aa, Artificial Sequence
  Description of Artificial Sequence: Synthetic polypeptide
  XENP023592 1C11_H3_L3.18_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 234 - protein, 117 aa, Artificial Sequence; identical to SEQ ID NO: 32
  Description of Artificial Sequence: Synthetic polypeptide
  VH of XENP023592

SEQ ID NO: 235 - protein, 114 aa, Artificial Sequence
  Description of Artificial Sequence: Synthetic polypeptide
  VL of XENP023592
DVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 236 - protein, 5 aa, Artificial Sequence
  Description of Artificial Sequence: Synthetic peptide
  XENP023592 vhCDR1
HYGMN

SEQ ID NO: 237 - protein, 17 aa, Artificial Sequence
  Description of Artificial Sequence: Synthetic peptide
  XENP023592 vhCDR2
WINTYTGEPTYADGFTG

SEQ ID NO: 238 - protein, 8 aa, Artificial Sequence
  Description of Artificial Sequence: Synthetic peptide
  XENP023592 vhCDR3
DYYGSSPY

SEQ ID NO: 239 - protein, 16 aa, Artificial Sequence
  Description of Artificial Sequence: Synthetic peptide
  XENP023592 vlCDR1
KSSQSIVHSNGNTYLE

SEQ ID NO: 240 - protein, 7 aa, Artificial Sequence
  Description of Artificial Sequence: Synthetic peptide
  XENP023592 vlCDR2
KVSNRFS

SEQ ID NO: 241 - protein, 9 aa, Artificial Sequence
  Description of Artificial Sequence: Synthetic peptide
  XENP023592 vlCDR3
FQGSHVPNT

SEQ ID NO: 242 - protein, 251 aa, Artificial Sequence
  Description of Artificial Sequence: Synthetic polypeptide
  XENP023593 1C11_H3_L3.19_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 243 - protein, 117 aa, Artificial Sequence; identical to SEQ ID NO: 32
  Description of Artificial Sequence: Synthetic polypeptide
  VH of XENP023593

SEQ ID NO: 244 - protein, 114 aa, Artificial Sequence
  Description of Artificial Sequence: Synthetic polypeptide
  VL of XENP023593
DVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 245 - protein, 5 aa, Artificial Sequence
  Description of Artificial Sequence: Synthetic peptide
  XENP023593 vhCDR1
HYGMN

SEQ ID NO: 246 - protein, 17 aa, Artificial Sequence
  Description of Artificial Sequence: Synthetic peptide
  XENP023593 vhCDR2
WINTYTGEPTYADGFTG

SEQ ID NO: 247 - protein, 8 aa, Artificial Sequence
  Description of Artificial Sequence: Synthetic peptide
  XENP023593 vhCDR3
DYYGSSPY

SEQ ID NO: 248 - protein, 16 aa, Artificial Sequence
  Description of Artificial Sequence: Synthetic peptide
  XENP023593 vlCDR1
KSSQSIVHSNGNTYLE

SEQ ID NO: 249 - protein, 7 aa, Artificial Sequence
  Description of Artificial Sequence: Synthetic peptide
  XENP023593 vlCDR2
KVSNRFS

SEQ ID NO: 250 - protein, 9 aa, Artificial Sequence
  Description of Artificial Sequence: Synthetic peptide
  XENP023593 vlCDR3
FQGSHVPNT

SEQ ID NO: 251 - protein, 251 aa, Artificial Sequence
  Description of Artificial Sequence: Synthetic polypeptide
  XENP023594 1C11_H3_L3.20_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 252 - protein, 117 aa, Artificial Sequence; identical to SEQ ID NO: 32
  Description of Artificial Sequence: Synthetic polypeptide
  VH of XENP023594

SEQ ID NO: 253 - protein, 114 aa, Artificial Sequence
  Description of Artificial Sequence: Synthetic polypeptide
  VL of XENP023594
DVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 254 - protein, 5 aa, Artificial Sequence
  Description of Artificial Sequence: Synthetic peptide
  XENP023594 vhCDR1
HYGMN

SEQ ID NO: 255 - protein, 17 aa, Artificial Sequence
  Description of Artificial Sequence: Synthetic peptide
  XENP023594 vhCDR2
WINTYTGEPTYADGFTG

SEQ ID NO: 256 - protein, 8 aa, Artificial Sequence
  Description of Artificial Sequence: Synthetic peptide
  XENP023594 vhCDR3
DYYGSSPY

SEQ ID NO: 257 - protein, 16 aa, Artificial Sequence
  Description of Artificial Sequence: Synthetic peptide
  XENP023594 vlCDR1
KSSQSIVHSNGNTYLE

SEQ ID NO: 258 - protein, 7 aa, Artificial Sequence
  Description of Artificial Sequence: Synthetic peptide
  XENP023594 vlCDR2
KVSNRFS

SEQ ID NO: 259 - protein, 9 aa, Artificial Sequence
  Description of Artificial Sequence: Synthetic peptide
  XENP023594 vlCDR3
FQGSHVPNT

SEQ ID NO: 260 - protein, 251 aa, Artificial Sequence
  Description of Artificial Sequence: Synthetic polypeptide
  XENP023595 1C11_H3_L3.21_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 261 - protein, 117 aa, Artificial Sequence; identical to SEQ ID NO: 32
  Description of Artificial Sequence: Synthetic polypeptide
  VH of XENP023595

SEQ ID NO: 262 - protein, 114 aa, Artificial Sequence
  Description of Artificial Sequence: Synthetic polypeptide
  VL of XENP023595
DVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 263 - protein, 5 aa, Artificial Sequence
  Description of Artificial Sequence: Synthetic peptide
  XENP023595 vhCDR1
HYGMN

SEQ ID NO: 264 - protein, 17 aa, Artificial Sequence
  Description of Artificial Sequence: Synthetic peptide
  XENP023595 vhCDR2
WINTYTGEPTYADGFTG

SEQ ID NO: 265 - protein, 8 aa, Artificial Sequence
  Description of Artificial Sequence: Synthetic peptide
  XENP023595 vhCDR3
DYYGSSPY

SEQ ID NO: 266 - protein, 16 aa, Artificial Sequence
  Description of Artificial Sequence: Synthetic peptide
  XENP023595 vlCDR1
KSSQSIVHSNGNTYLE

SEQ ID NO: 267 - protein, 7 aa, Artificial Sequence
  Description of Artificial Sequence: Synthetic peptide
  XENP023595 vlCDR2
KVSNRFS

SEQ ID NO: 268 - protein, 9 aa, Artificial Sequence
  Description of Artificial Sequence: Synthetic peptide
  XENP023595 vlCDR3
FQGSHVPNT

SEQ ID NO: 269 - protein, 251 aa, Artificial Sequence
  Description of Artificial Sequence: Synthetic polypeptide
  XENP023596 1C11_H3_L3.22_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 270 - protein, 117 aa, Artificial Sequence; identical to SEQ ID NO: 32
  Description of Artificial Sequence: Synthetic polypeptide
  VH of XENP023596

SEQ ID NO: 271 - protein, 114 aa, Artificial Sequence
  Description of Artificial Sequence: Synthetic polypeptide
  VL of XENP023596
DVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 272 - protein, 5 aa, Artificial Sequence
  Description of Artificial Sequence: Synthetic peptide
  XENP023596 vhCDR1
HYGMN

SEQ ID NO: 273 - protein, 17 aa, Artificial Sequence
  Description of Artificial Sequence: Synthetic peptide
  XENP023596 vhCDR2
WINTYTGEPTYADGFTG

SEQ ID NO: 274 - protein, 8 aa, Artificial Sequence
  Description of Artificial Sequence: Synthetic peptide
  XENP023596 vhCDR3
DYYGSSPY

SEQ ID NO: 275 - protein, 16 aa, Artificial Sequence
  Description of Artificial Sequence: Synthetic peptide
  XENP023596 vlCDR1
KSSQSIVHSNGNTYLE

SEQ ID NO: 276 - protein, 7 aa, Artificial Sequence
  Description of Artificial Sequence: Synthetic peptide
  XENP023596 vlCDR2
KVSNRFS

SEQ ID NO: 277 - protein, 9 aa, Artificial Sequence
  Description of Artificial Sequence: Synthetic peptide
  XENP023596 vlCDR3
FQGSHVPNT

SEQ ID NO: 278 - protein, 251 aa, Artificial Sequence
  Description of Artificial Sequence: Synthetic polypeptide
  XENP023601 1C11_H3_L3.23_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 279 - protein, 117 aa, Artificial Sequence; identical to SEQ ID NO: 32
  Description of Artificial Sequence: Synthetic polypeptide
  VH of XENP023601

SEQ ID NO: 280 - protein, 114 aa, Artificial Sequence
  Description of Artificial Sequence: Synthetic polypeptide
  VL of XENP023601
DVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 281 - protein, 5 aa, Artificial Sequence
  Description of Artificial Sequence: Synthetic peptide
  XENP023601 vhCDR1
HYGMN

SEQ ID NO: 282 - protein, 17 aa, Artificial Sequence
  Description of Artificial Sequence: Synthetic peptide
  XENP023601 vhCDR2
WINTYTGEPTYADGFTG

SEQ ID NO: 283 - protein, 8 aa, Artificial Sequence
  Description of Artificial Sequence: Synthetic peptide
  XENP023601 vhCDR3
DYYGSSPY

SEQ ID NO: 284 - protein, 16 aa, Artificial Sequence
  Description of Artificial Sequence: Synthetic peptide
  XENP023601 vlCDR1
KSSQSIVHSNGNTYLE

SEQ ID NO: 285 - protein, 7 aa, Artificial Sequence
  Description of Artificial Sequence: Synthetic peptide
  XENP023601 vlCDR2
KVSNRFS

SEQ ID NO: 286 - protein, 9 aa, Artificial Sequence
  Description of Artificial Sequence: Synthetic peptide
  XENP023601 vlCDR3
FQGSHVPNT

SEQ ID NO: 287 - protein, 251 aa, Artificial Sequence
  Description of Artificial Sequence: Synthetic polypeptide
  XENP023602 1C11_H3_L3.25_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 288 - protein, 117 aa, Artificial Sequence; identical to SEQ ID NO: 32
  Description of Artificial Sequence: Synthetic polypeptide
  VH of XENP023602

SEQ ID NO: 289 - protein, 114 aa, Artificial Sequence
  Description of Artificial Sequence: Synthetic polypeptide
  VL of XENP023602
DVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 290 - protein, 5 aa, Artificial Sequence
  Description of Artificial Sequence: Synthetic peptide
  XENP023602 vhCDR1
HYGMN

SEQ ID NO: 291 - protein, 17 aa, Artificial Sequence
  Description of Artificial Sequence: Synthetic peptide
  XENP023602 vhCDR2
WINTYTGEPTYADGFTG

SEQ ID NO: 292 - protein, 8 aa, Artificial Sequence
  Description of Artificial Sequence: Synthetic peptide
  XENP023602 vhCDR3
DYYGSSPY

SEQ ID NO: 293 - protein, 16 aa, Artificial Sequence
  Description of Artificial Sequence: Synthetic peptide
  XENP023602 vlCDR1
KSSQSIVHSNGNTYLE

SEQ ID NO: 294 - protein, 7 aa, Artificial Sequence
  Description of Artificial Sequence: Synthetic peptide
  XENP023602 vlCDR2
KVSNRFS

SEQ ID NO: 295 - protein, 9 aa, Artificial Sequence
  Description of Artificial Sequence: Synthetic peptide
  XENP023602 vlCDR3
FQGSHVPNT

SEQ ID NO: 296 - protein, 251 aa, Artificial Sequence
  Description of Artificial Sequence: Synthetic polypeptide
  XENP023603 1C11_H3_L3.26_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 297 - protein, 117 aa, Artificial Sequence; identical to SEQ ID NO: 32
  Description of Artificial Sequence: Synthetic polypeptide
  VH of XENP023603

SEQ ID NO: 298 - protein, 114 aa, Artificial Sequence
  Description of Artificial Sequence: Synthetic polypeptide
  VL of XENP023603
DVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 299 - protein, 5 aa, Artificial Sequence
  Description of Artificial Sequence: Synthetic peptide
  XENP023603 vhCDR1
HYGMN

SEQ ID NO: 300 - protein, 17 aa, Artificial Sequence
  Description of Artificial Sequence: Synthetic peptide
  XENP023603 vhCDR2
WINTYTGEPTYADGFTG

SEQ ID NO: 301 - protein, 8 aa, Artificial Sequence
  Description of Artificial Sequence: Synthetic peptide
  XENP023603 vhCDR3
DYYGSSPY

SEQ ID NO: 302 - protein, 16 aa, Artificial Sequence
  Description of Artificial Sequence: Synthetic peptide
  XENP023603 vlCDR1
KSSQSIVHSNGNTYLE

SEQ ID NO: 303 - protein, 7 aa, Artificial Sequence
  Description of Artificial Sequence: Synthetic peptide
  XENP023603 vlCDR2
KVSNRFS

SEQ ID NO: 304 - protein, 9 aa, Artificial Sequence
  Description of Artificial Sequence: Synthetic peptide
  XENP023603 vlCDR3
FQGSHVPNT

SEQ ID NO: 305 - protein, 251 aa, Artificial Sequence
  Description of Artificial Sequence: Synthetic polypeptide
  XENP023604 1C11_H3_L3.27_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 306 - protein, 117 aa, Artificial Sequence; identical to SEQ ID NO: 32
  Description of Artificial Sequence: Synthetic polypeptide
  VH of XENP023604

SEQ ID NO: 307 - protein, 114 aa, Artificial Sequence
  Description of Artificial Sequence: Synthetic polypeptide
  VL of XENP023604
DVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 308 - protein, 5 aa, Artificial Sequence
  Description of Artificial Sequence: Synthetic peptide
  XENP023604 vhCDR1
HYGMN

SEQ ID NO: 309 - protein, 17 aa, Artificial Sequence
  Description of Artificial Sequence: Synthetic peptide
  XENP023604 vhCDR2
WINTYTGEPTYADGFTG

SEQ ID NO: 310 - protein, 8 aa, Artificial Sequence
  Description of Artificial Sequence: Synthetic peptide
  XENP023604 vhCDR3
DYYGSSPY

SEQ ID NO: 311 - protein, 16 aa, Artificial Sequence
  Description of Artificial Sequence: Synthetic peptide
  XENP023604 vlCDR1
QSSQSIVHSNGNTYLE

SEQ ID NO: 312 - protein, 7 aa, Artificial Sequence
  Description of Artificial Sequence: Synthetic peptide
  XENP023604 vlCDR2
KVSNRFS

SEQ ID NO: 313 - protein, 9 aa, Artificial Sequence
  Description of Artificial Sequence: Synthetic peptide
  XENP023604 vlCDR3
FQGSHVPNT

SEQ ID NO: 314 - protein, 251 aa, Artificial Sequence
  Description of Artificial Sequence: Synthetic polypeptide
  XENP023605 1C11_H3_L3.28_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 315 - protein, 117 aa, Artificial Sequence; identical to SEQ ID NO: 32
  Description of Artificial Sequence: Synthetic polypeptide
  VH of XENP023605

SEQ ID NO: 316 - protein, 114 aa, Artificial Sequence
  Description of Artificial Sequence: Synthetic polypeptide
  VL of XENP023605
DVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 317 - protein, 5 aa, Artificial Sequence
  Description of Artificial Sequence: Synthetic peptide
  XENP023605 vhCDR1
HYGMN

SEQ ID NO: 318 - protein, 17 aa, Artificial Sequence
  Description of Artificial Sequence: Synthetic peptide
  XENP023605 vhCDR2
WINTYTGEPTYADGFTG

SEQ ID NO: 319 - protein, 8 aa, Artificial Sequence
  Description of Artificial Sequence: Synthetic peptide
  XENP023605 vhCDR3
DYYGSSPY

SEQ ID NO: 320 - protein, 16 aa, Artificial Sequence
  Description of Artificial Sequence: Synthetic peptide
  XENP023605 vlCDR1
RSSQSIVHSNGNTYLE

SEQ ID NO: 321 - protein, 7 aa, Artificial Sequence
  Description of Artificial Sequence: Synthetic peptide
  XENP023605 vlCDR2
KVSNRFS

SEQ ID NO: 322 - protein, 9 aa, Artificial Sequence
  Description of Artificial Sequence: Synthetic peptide
  XENP023605 vlCDR3
FQGSHVPNT

SEQ ID NO: 323 - protein, 251 aa, Artificial Sequence
  Description of Artificial Sequence: Synthetic polypeptide
  XENP023606 1C11_H3_L3.29_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 324 - protein, 117 aa, Artificial Sequence; identical to SEQ ID NO: 32
  Description of Artificial Sequence: Synthetic polypeptide
  VH of XENP023606

SEQ ID NO: 325 - protein, 114 aa, Artificial Sequence
  Description of Artificial Sequence: Synthetic polypeptide
  VL of XENP023606
DVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 326 - protein, 5 aa, Artificial Sequence
  Description of Artificial Sequence: Synthetic peptide
  XENP023606 vhCDR1
HYGMN

SEQ ID NO: 327 - protein, 17 aa, Artificial Sequence
  Description of Artificial Sequence: Synthetic peptide
  XENP023606 vhCDR2
WINTYTGEPTYADGFTG

SEQ ID NO: 328 - protein, 8 aa, Artificial Sequence
  Description of Artificial Sequence: Synthetic peptide
  XENP023606 vhCDR3
DYYGSSPY

SEQ ID NO: 329 - protein, 16 aa, Artificial Sequence
  Description of Artificial Sequence: Synthetic peptide
  XENP023606 vlCDR1
SSSQSIVHSNGNTYLE

SEQ ID NO: 330 - protein, 7 aa, Artificial Sequence
  Description of Artificial Sequence: Synthetic peptide
  XENP023606 vlCDR2
KVSNRFS

SEQ ID NO: 331 - protein, 9 aa, Artificial Sequence
  Description of Artificial Sequence: Synthetic peptide
  XENP023606 vlCDR3
FQGSHVPNT

SEQ ID NO: 332 - protein, 251 aa, Artificial Sequence
  Description of Artificial Sequence: Synthetic polypeptide
  XENP023607 1C11_H3_L3.30_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 333 - protein, 117 aa, Artificial Sequence; identical to SEQ ID NO: 32
  Description of Artificial Sequence: Synthetic polypeptide
  VH of XENP023607

SEQ ID NO: 334 - protein, 114 aa, Artificial Sequence
  Description of Artificial Sequence: Synthetic polypeptide
  VL of XENP023607
DVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 335 - protein, 5 aa, Artificial Sequence
  Description of Artificial Sequence: Synthetic peptide
  XENP023607 vhCDR1
HYGMN

SEQ ID NO: 336 - protein, 17 aa, Artificial Sequence
  Description of Artificial Sequence: Synthetic peptide
  XENP023607 vhCDR2
WINTYTGEPTYADGFTG

SEQ ID NO: 337 - protein, 8 aa, Artificial Sequence
  Description of Artificial Sequence: Synthetic peptide
  XENP023607 vhCDR3
DYYGSSPY

SEQ ID NO: 338 - protein, 16 aa, Artificial Sequence
  Description of Artificial Sequence: Synthetic peptide
  XENP023607 vlCDR1
TSSQSIVHSNGNTYLE

SEQ ID NO: 339 - protein, 7 aa, Artificial Sequence
  Description of Artificial Sequence: Synthetic peptide
  XENP023607 vlCDR2
KVSNRFS

SEQ ID NO: 340 - protein, 9 aa, Artificial Sequence
  Description of Artificial Sequence: Synthetic peptide
  XENP023607 vlCDR3
FQGSHVPNT

SEQ ID NO: 341 - protein, 251 aa, Artificial Sequence
  Description of Artificial Sequence: Synthetic polypeptide
  XENP023608 1C11_H3_L3.31_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 342 - protein, 117 aa, Artificial Sequence; identical to SEQ ID NO: 32
  Description of Artificial Sequence: Synthetic polypeptide
  VH of XENP023608

SEQ ID NO: 343 - protein, 114 aa, Artificial Sequence
  Description of Artificial Sequence: Synthetic polypeptide
  VL of XENP023608
DVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 344 - protein, 5 aa, Artificial Sequence
  Description of Artificial Sequence: Synthetic peptide
  XENP023608 vhCDR1
HYGMN

SEQ ID NO: 345 - protein, 17 aa, Artificial Sequence
  Description of Artificial Sequence: Synthetic peptide
  XENP023608 vhCDR2
WINTYTGEPTYADGFTG

SEQ ID NO: 346 - protein, 8 aa, Artificial Sequence
  Description of Artificial Sequence: Synthetic peptide
  XENP023608 vhCDR3
DYYGSSPY

SEQ ID NO: 347 - protein, 16 aa, Artificial Sequence
  Description of Artificial Sequence: Synthetic peptide
  XENP023608 vlCDR1
KTSQSIVHSNGNTYLE

SEQ ID NO: 348 - protein, 7 aa, Artificial Sequence
  Description of Artificial Sequence: Synthetic peptide
  XENP023608 vlCDR2
KVSNRFS

SEQ ID NO: 349 - protein, 9 aa, Artificial Sequence
  Description of Artificial Sequence: Synthetic peptide
  XENP023608 vlCDR3
FQGSHVPNT

SEQ ID NO: 350 - protein, 251 aa, Artificial Sequence
  Description of Artificial Sequence: Synthetic polypeptide
  XENP023609 1C11_H3_L3.32_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 351 - protein, 117 aa, Artificial Sequence; identical to SEQ ID NO: 32
  Description of Artificial Sequence: Synthetic polypeptide
  VH of XENP023609

SEQ ID NO: 352 - protein, 114 aa, Artificial Sequence
  Description of Artificial Sequence: Synthetic polypeptide
  VL of XENP023609
DVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 353 - protein, 5 aa, Artificial Sequence
  Description of Artificial Sequence: Synthetic peptide
  XENP023609 vhCDR1
HYGMN

SEQ ID NO: 354 - protein, 17 aa, Artificial Sequence
  Description of Artificial Sequence: Synthetic peptide
  XENP023609 vhCDR2
WINTYTGEPTYADGFTG

SEQ ID NO: 355 - protein, 8 aa, Artificial Sequence
  Description of Artificial Sequence: Synthetic peptide
  XENP023609 vhCDR3
DYYGSSPY

SEQ ID NO: 356 - protein, 16 aa, Artificial Sequence
  Description of Artificial Sequence: Synthetic peptide
  XENP023609 vlCDR1
KASQSIVHSNGNTYLE

SEQ ID NO: 357 - protein, 7 aa, Artificial Sequence
  Description of Artificial Sequence: Synthetic peptide
  XENP023609 vlCDR2
KVSNRFS

SEQ ID NO: 358 - protein, 9 aa, Artificial Sequence
  Description of Artificial Sequence: Synthetic peptide
  XENP023609 vlCDR3
FQGSHVPNT

SEQ ID NO: 359 - protein, 251 aa, Artificial Sequence
  Description of Artificial Sequence: Synthetic polypeptide
  XENP023610 1C11_H3_L3.34_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 360 - protein, 117 aa, Artificial Sequence; identical to SEQ ID NO: 32
  Description of Artificial Sequence: Synthetic polypeptide
  VH of XENP023610

SEQ ID NO: 361 - protein, 114 aa, Artificial Sequence
  Description of Artificial Sequence: Synthetic polypeptide
  VL of XENP023610
DVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 362 - protein, 5 aa, Artificial Sequence
  Description of Artificial Sequence: Synthetic peptide
  XENP023610 vhCDR1
HYGMN

SEQ ID NO: 363 - protein, 17 aa, Artificial Sequence
  Description of Artificial Sequence: Synthetic peptide
  XENP023610 vhCDR2
WINTYTGEPTYADGFTG

SEQ ID NO: 364 - protein, 8 aa, Artificial Sequence
  Description of Artificial Sequence: Synthetic peptide
  XENP023610 vhCDR3
DYYGSSPY

SEQ ID NO: 365 - protein, 16 aa, Artificial Sequence
  Description of Artificial Sequence: Synthetic peptide
  XENP023610 vlCDR1
KSSQSVVHSNGNTYLE

SEQ ID NO: 366 - protein, 7 aa, Artificial Sequence
  Description of Artificial Sequence: Synthetic peptide
  XENP023610 vlCDR2
KVSNRFS

SEQ ID NO: 367 - protein, 9 aa, Artificial Sequence
  Description of Artificial Sequence: Synthetic peptide
  XENP023610 vlCDR3
FQGSHVPNT

SEQ ID NO: 368 - protein, 251 aa, Artificial Sequence
  Description of Artificial Sequence: Synthetic polypeptide
  XENP023611 1C11_H3_L3.35_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 369 - protein, 117 aa, Artificial Sequence; identical to SEQ ID NO: 32
  Description of Artificial Sequence: Synthetic polypeptide
  VH of XENP023611

SEQ ID NO: 370 - protein, 114 aa, Artificial Sequence
  Description of Artificial Sequence: Synthetic polypeptide
  VL of XENP023611
DVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 371 - protein, 5 aa, Artificial Sequence
  Description of Artificial Sequence: Synthetic peptide
  XENP023611 vhCDR1
HYGMN

SEQ ID NO: 372 - protein, 17 aa, Artificial Sequence
  Description of Artificial Sequence: Synthetic peptide
  XENP023611 vhCDR2
WINTYTGEPTYADGFTG

SEQ ID NO: 373 - protein, 8 aa, Artificial Sequence
  Description of Artificial Sequence: Synthetic peptide
  XENP023611 vhCDR3
DYYGSSPY

SEQ ID NO: 374 - protein, 16 aa, Artificial Sequence
  Description of Artificial Sequence: Synthetic peptide
  XENP023611 vlCDR1
KSSQSAVHSNGNTYLE

SEQ ID NO: 375 - protein, 7 aa, Artificial Sequence
  Description of Artificial Sequence: Synthetic peptide
  XENP023611 vlCDR2
KVSNRFS

SEQ ID NO: 376 - protein, 9 aa, Artificial Sequence
  Description of Artificial Sequence: Synthetic peptide
  XENP023611 vlCDR3
FQGSHVPNT

SEQ ID NO: 377 - protein, 251 aa, Artificial Sequence
  Description of Artificial Sequence: Synthetic polypeptide
  XENP023612 1C11_H3_L3.36_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 378 - protein, 117 aa, Artificial Sequence; identical to SEQ ID NO: 32
  Description of Artificial Sequence: Synthetic polypeptide
  VH of XENP023612

SEQ ID NO: 379 - protein, 114 aa, Artificial Sequence
  Description of Artificial Sequence: Synthetic polypeptide
  VL of XENP023612
DVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 380 - protein, 5 aa, Artificial Sequence
  Description of Artificial Sequence: Synthetic peptide
  XENP023612 vhCDR1
HYGMN

SEQ ID NO: 381 - protein, 17 aa, Artificial Sequence
  Description of Artificial Sequence: Synthetic peptide
  XENP023612 vhCDR2
WINTYTGEPTYADGFTG

SEQ ID NO: 382 - protein, 8 aa, Artificial Sequence
  Description of Artificial Sequence: Synthetic peptide
  XENP023612 vhCDR3
DYYGSSPY

SEQ ID NO: 383 - protein, 16 aa, Artificial Sequence
  Description of Artificial Sequence: Synthetic peptide
  XENP023612 vlCDR1
KSSQSIVHSSNNTYLE

SEQ ID NO: 384 - protein, 7 aa, Artificial Sequence
  Description of Artificial Sequence: Synthetic peptide
  XENP023612 vlCDR2
KVSNRFS

SEQ ID NO: 385 - protein, 9 aa, Artificial Sequence
  Description of Artificial Sequence: Synthetic peptide
  XENP023612 vlCDR3
FQGSHVPNT

SEQ ID NO: 386 - protein, 251 aa, Artificial Sequence
  Description of Artificial Sequence: Synthetic polypeptide
  XENP023613 1C11_H3_L3.37_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 387 - protein, 117 aa, Artificial Sequence; identical to SEQ ID NO: 32
  Description of Artificial Sequence: Synthetic polypeptide
  VH of XENP023613

SEQ ID NO: 388 - protein, 114 aa, Artificial Sequence
  Description of Artificial Sequence: Synthetic polypeptide
  VL of XENP023613
DVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 389 - protein, 5 aa, Artificial Sequence
  Description of Artificial Sequence: Synthetic peptide
  XENP023613 vhCDR1
HYGMN

SEQ ID NO: 390 - protein, 17 aa, Artificial Sequence
  Description of Artificial Sequence: Synthetic peptide
  XENP023613 vhCDR2
WINTYTGEPTYADGFTG

SEQ ID NO: 391 - protein, 8 aa, Artificial Sequence
  Description of Artificial Sequence: Synthetic peptide
  XENP023613 vhCDR3
DYYGSSPY

SEQ ID NO: 392 - protein, 16 aa, Artificial Sequence
  Description of Artificial Sequence: Synthetic peptide
  XENP023613 vlCDR1
KSSQSIVHSNGNSYLE

SEQ ID NO: 393 - protein, 7 aa, Artificial Sequence
  Description of Artificial Sequence: Synthetic peptide
  XENP023613 vlCDR2
KVSNRFS

SEQ ID NO: 394 - protein, 9 aa, Artificial Sequence
  Description of Artificial Sequence: Synthetic peptide
  XENP023613 vlCDR3
FQGSHVPNT

SEQ ID NO: 395 - protein, 251 aa, Artificial Sequence
  Description of Artificial Sequence: Synthetic polypeptide
  XENP023614 1C11_H3_L3.38_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 396 - protein, 117 aa, Artificial Sequence; identical to SEQ ID NO: 32
  Description of Artificial Sequence: Synthetic polypeptide
  VH of XENP023614

SEQ ID NO: 397 - protein, 114 aa, Artificial Sequence
  Description of Artificial Sequence: Synthetic polypeptide
  VL of XENP023614
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 398 - protein, 5 aa, Artificial Sequence
  Description of Artificial Sequence: Synthetic peptide
  XENP023614 vhCDR1
HYGMN

SEQ ID NO: 399 - protein, 17 aa, Artificial Sequence
  Description of Artificial Sequence: Synthetic peptide
  XENP023614 vhCDR2
WINTYTGEPTYADGFTG

SEQ ID NO: 400 - protein, 8 aa, Artificial Sequence
  Description of Artificial Sequence: Synthetic peptide
  XENP023614 vhCDR3
DYYGSSPY

SEQ ID NO: 401 - protein, 16 aa, Artificial Sequence
  Description of Artificial Sequence: Synthetic peptide
  XENP023614 vlCDR1
KSSQSIVHSNGNNYLE

SEQ ID NO: 402 - protein, 7 aa, Artificial Sequence
  Description of Artificial Sequence: Synthetic peptide
  XENP023614 vlCDR2
KVSNRFS

SEQ ID NO: 403 - protein, 9 aa, Artificial Sequence
  Description of Artificial Sequence: Synthetic peptide
  XENP023614 vlCDR3
FQGSHVPNT

SEQ ID NO: 404 - protein, 251 aa, Artificial Sequence
  Description of Artificial Sequence: Synthetic polypeptide
  XENP023615 1C11_H3_L3.46_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 405 - protein, 117 aa, Artificial Sequence; identical to SEQ ID NO: 32
  Description of Artificial Sequence: Synthetic polypeptide
  VH of XENP023615

SEQ ID NO: 406 - protein, 114 aa, Artificial Sequence
  Description of Artificial Sequence: Synthetic polypeptide
  VL of XENP023615
DVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 407 - protein, 5 aa, Artificial Sequence
  Description of Artificial Sequence: Synthetic peptide
  XENP023615 vhCDR1
HYGMN

SEQ ID NO: 408 - protein, 17 aa, Artificial Sequence
  Description of Artificial Sequence: Synthetic peptide
  XENP023615 vhCDR2
WINTYTGEPTYADGFTG

SEQ ID NO: 409 - protein, 8 aa, Artificial Sequence
  Description of Artificial Sequence: Synthetic peptide
  XENP023615 vhCDR3
DYYGSSPY

SEQ ID NO: 410 - protein, 16 aa, Artificial Sequence
  Description of Artificial Sequence: Synthetic peptide
  XENP023615 vlCDR1
KSSQSIVHSNGNTYLE

SEQ ID NO: 411 - protein, 7 aa, Artificial Sequence
  Description of Artificial Sequence: Synthetic peptide
  XENP023615 vlCDR2
KVSNRFS

SEQ ID NO: 412 - protein, 9 aa, Artificial Sequence
  Description of Artificial Sequence: Synthetic peptide
  XENP023615 vlCDR3
FQGSHVPNT

SEQ ID NO: 413 - protein, 251 aa, Artificial Sequence
  Description of Artificial Sequence: Synthetic polypeptide
  XENP023616 1C11_H3_L3.47_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 414 - protein, 117 aa, Artificial Sequence; identical to SEQ ID NO: 32
  Description of Artificial Sequence: Synthetic polypeptide
  VH of XENP023616

SEQ ID NO: 415 - protein, 114 aa, Artificial Sequence
  Description of Artificial Sequence: Synthetic polypeptide
  VL of XENP023616
DVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 416 - protein, 5 aa, Artificial Sequence
  Description of Artificial Sequence: Synthetic peptide
  XENP023616 vhCDR1
HYGMN

SEQ ID NO: 417 - protein, 17 aa, Artificial Sequence
  Description of Artificial Sequence: Synthetic peptide
  XENP023616 vhCDR2
WINTYTGEPTYADGFTG

SEQ ID NO: 418 - protein, 8 aa, Artificial Sequence
  Description of Artificial Sequence: Synthetic peptide
  XENP023616 vhCDR3
DYYGSSPY

SEQ ID NO: 419 - protein, 16 aa, Artificial Sequence
  Description of Artificial Sequence: Synthetic peptide
  XENP023616 vlCDR1
KSSQSIVHSNGNTYLE

SEQ ID NO: 420 - protein, 7 aa, Artificial Sequence
  Description of Artificial Sequence: Synthetic peptide
  XENP023616 vlCDR2
KVSNRFS

SEQ ID NO: 421 - protein, 9 aa, Artificial Sequence
  Description of Artificial Sequence: Synthetic peptide
  XENP023616 vlCDR3
FQGSHVPNT

SEQ ID NO: 422 - protein, 251 aa, Artificial Sequence
  Description of Artificial Sequence: Synthetic polypeptide
  XENP023617 1C11_H3_L3.49_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 423 - protein, 117 aa, Artificial Sequence; identical to SEQ ID NO: 32
  Description of Artificial Sequence: Synthetic polypeptide
  VH of XENP023617

SEQ ID NO: 424 - protein, 114 aa, Artificial Sequence
  Description of Artificial Sequence: Synthetic polypeptide
  VL of XENP023617
DVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 425 - protein, 5 aa, Artificial Sequence
  Description of Artificial Sequence: Synthetic peptide
  XENP023617 vhCDR1
HYGMN

SEQ ID NO: 426 - protein, 17 aa, Artificial Sequence
  Description of Artificial Sequence: Synthetic peptide
  XENP023617 vhCDR2
WINTYTGEPTYADGFTG

SEQ ID NO: 427 - protein, 8 aa, Artificial Sequence
  Description of Artificial Sequence: Synthetic peptide
  XENP023617 vhCDR3
DYYGSSPY

SEQ ID NO: 428 - protein, 16 aa, Artificial Sequence
  Description of Artificial Sequence: Synthetic peptide
  XENP023617 vlCDR1
KSSQSIVHSNGNTYLE

SEQ ID NO: 429 - protein, 7 aa, Artificial Sequence
  Description of Artificial Sequence: Synthetic peptide
  XENP023617 vlCDR2
GVSNRFS

SEQ ID NO: 430 - protein, 9 aa, Artificial Sequence
  Description of Artificial Sequence: Synthetic peptide
  XENP023617 vlCDR3
FQGSHVPNT

SEQ ID NO: 431 - protein, 251 aa, Artificial Sequence
  Description of Artificial Sequence: Synthetic polypeptide
  XENP023618 1C11_H3_L3.50_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 432 - protein, 117 aa, Artificial Sequence; identical to SEQ ID NO: 32
  Description of Artificial Sequence: Synthetic polypeptide
  VH of XENP023618

SEQ ID NO: 433 - protein, 114 aa, Artificial Sequence
  Description of Artificial Sequence: Synthetic polypeptide
  VL of XENP023618
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 434 - protein, 5 aa, Artificial Sequence
  Description of Artificial Sequence: Synthetic peptide
  XENP023618 vhCDR1
HYGMN

SEQ ID NO: 435 - protein, 17 aa, Artificial Sequence
  Description of Artificial Sequence: Synthetic peptide
  XENP023618 vhCDR2
WINTYTGEPTYADGFTG

SEQ ID NO: 436 - protein, 8 aa, Artificial Sequence
  Description of Artificial Sequence: Synthetic peptide
  XENP023618 vhCDR3
DYYGSSPY

SEQ ID NO: 437 - protein, 16 aa, Artificial Sequence
  Description of Artificial Sequence: Synthetic peptide
  XENP023618 vlCDR1
KSSQSIVHSNGNTYLE

SEQ ID NO: 438 - protein, 7 aa, Artificial Sequence
  Description of Artificial Sequence: Synthetic peptide
  XENP023618 vlCDR2
SVSNRFS

SEQ ID NO: 439 - protein, 9 aa, Artificial Sequence
  Description of Artificial Sequence: Synthetic peptide
  XENP023618 vlCDR3
FQGSHVPNT

SEQ ID NO: 440 - protein, 251 aa, Artificial Sequence
  Description of Artificial Sequence: Synthetic polypeptide
  XENP023619 1C11_H3_L3.51_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 441 - protein, 117 aa, Artificial Sequence; identical to SEQ ID NO: 32
  Description of Artificial Sequence: Synthetic polypeptide
  VH of XENP023619

SEQ ID NO: 442 - protein, 114 aa, Artificial Sequence
  Description of Artificial Sequence: Synthetic polypeptide
  VL of XENP023619
DVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 443 - protein, 5 aa, Artificial Sequence
  Description of Artificial Sequence: Synthetic peptide
  XENP023619 vhCDR1
HYGMN

SEQ ID NO: 444 - protein, 17 aa, Artificial Sequence
  Description of Artificial Sequence: Synthetic peptide
  XENP023619 vhCDR2
WINTYTGEPTYADGFTG

SEQ ID NO: 445 - protein, 8 aa, Artificial Sequence
  Description of Artificial Sequence: Synthetic peptide
  XENP023619 vhCDR3
DYYGSSPY

SEQ ID NO: 446 - protein, 16 aa, Artificial Sequence
  Description of Artificial Sequence: Synthetic peptide
  XENP023619 vlCDR1
KSSQSIVHSNGNTYLE

SEQ ID NO: 447 - protein, 7 aa, Artificial Sequence
  Description of Artificial Sequence: Synthetic peptide
  XENP023619 vlCDR2
KASNRFS

SEQ ID NO: 448 - protein, 9 aa, Artificial Sequence
  Description of Artificial Sequence: Synthetic peptide
  XENP023619 vlCDR3
FQGSHVPNT

SEQ ID NO: 449 - protein, 251 aa, Artificial Sequence
  Description of Artificial Sequence: Synthetic polypeptide
  XENP023620 1C11_H3_L3.52_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 450 - protein, 117 aa, Artificial Sequence; identical to SEQ ID NO: 32
  Description of Artificial Sequence: Synthetic polypeptide
  VH of XENP023620

SEQ ID NO: 451 - protein, 114 aa, Artificial Sequence
  Description of Artificial Sequence: Synthetic polypeptide
  VL of XENP023620
DVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 452 - protein, 5 aa, Artificial Sequence
  Description of Artificial Sequence: Synthetic peptide
  XENP023620 vhCDR1
HYGMN

SEQ ID NO: 453 - protein, 17 aa, Artificial Sequence
  Description of Artificial Sequence: Synthetic peptide
  XENP023620 vhCDR2
WINTYTGEPTYADGFTG

SEQ ID NO: 454 - protein, 8 aa, Artificial Sequence
  Description of Artificial Sequence: Synthetic peptide
  XENP023620 vhCDR3
DYYGSSPY

SEQ ID NO: 455 - protein, 16 aa, Artificial Sequence
  Description of Artificial Sequence: Synthetic peptide
  XENP023620 vlCDR1
KSSQSIVHSNGNTYLE

SEQ ID NO: 456 - protein, 7 aa, Artificial Sequence
  Description of Artificial Sequence: Synthetic peptide
  XENP023620 vlCDR2
KTSNRFS

SEQ ID NO: 457 - protein, 9 aa, Artificial Sequence
  Description of Artificial Sequence: Synthetic peptide
  XENP023620 vlCDR3
FQGSHVPNT

SEQ ID NO: 458 - protein, 251 aa, Artificial Sequence
  Description of Artificial Sequence: Synthetic polypeptide
  XENP023621 1C11_H3_L3.53_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 459 - protein, 117 aa, Artificial Sequence; identical to SEQ ID NO: 32
  Description of Artificial Sequence: Synthetic polypeptide
  VH of XENP023621

SEQ ID NO: 460 - protein, 114 aa, Artificial Sequence
  Description of Artificial Sequence: Synthetic polypeptide
  VL of XENP023621
DVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 461 - protein, 5 aa, Artificial Sequence
  Description of Artificial Sequence: Synthetic peptide
  XENP023621 vhCDR1
HYGMN

SEQ ID NO: 462 - protein, 17 aa, Artificial Sequence
  Description of Artificial Sequence: Synthetic peptide
  XENP023621 vhCDR2
WINTYTGEPTYADGFTG

SEQ ID NO: 463 - protein, 8 aa, Artificial Sequence
  Description of Artificial Sequence: Synthetic peptide
  XENP023621 vhCDR3
DYYGSSPY

SEQ ID NO: 464 - protein, 16 aa, Artificial Sequence
  Description of Artificial Sequence: Synthetic peptide
  XENP023621 vlCDR1
KSSQSIVHSNGNTYLE

SEQ ID NO: 465 - protein, 7 aa, Artificial Sequence
  Description of Artificial Sequence: Synthetic peptide
  XENP023621 vlCDR2
KGSNRFS

SEQ ID NO: 466 - protein, 9 aa, Artificial Sequence
  Description of Artificial Sequence: Synthetic peptide
  XENP023621 vlCDR3
FQGSHVPNT

SEQ ID NO: 467 - protein, 251 aa, Artificial Sequence
  Description of Artificial Sequence: Synthetic polypeptide
  XENP023622 1C11_H3_L3.54_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 468 - protein, 117 aa, Artificial Sequence; identical to SEQ ID NO: 32
  Description of Artificial Sequence: Synthetic polypeptide
  VH of XENP023622

SEQ ID NO: 469 - protein, 114 aa, Artificial Sequence
  Description of Artificial Sequence: Synthetic polypeptide
  VL of XENP023622
DVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 470 - protein, 5 aa, Artificial Sequence
  Description of Artificial Sequence: Synthetic peptide
  XENP023622 vhCDR1
HYGMN

SEQ ID NO: 471 - protein, 17 aa, Artificial Sequence
  Description of Artificial Sequence: Synthetic peptide
  XENP023622 vhCDR2
WINTYTGEPTYADGFTG

SEQ ID NO: 472 - protein, 8 aa, Artificial Sequence
  Description of Artificial Sequence: Synthetic peptide
  XENP023622 vhCDR3
DYYGSSPY

SEQ ID NO: 473 - protein, 16 aa, Artificial Sequence
  Description of Artificial Sequence: Synthetic peptide
  XENP023622 vlCDR1
KSSQSIVHSNGNTYLE

SEQ ID NO: 474 - protein, 7 aa, Artificial Sequence
  Description of Artificial Sequence: Synthetic peptide
  XENP023622 vlCDR2
KMSNRFS

SEQ ID NO: 475 - protein, 9 aa, Artificial Sequence
  Description of Artificial Sequence: Synthetic peptide
  XENP023622 vlCDR3
FQGSHVPNT

SEQ ID NO: 476 - protein, 251 aa, Artificial Sequence
  Description of Artificial Sequence: Synthetic polypeptide
  XENP023623 1C11_H3_L3.56_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 477 - protein, 117 aa, Artificial Sequence; identical to SEQ ID NO: 32
  Description of Artificial Sequence: Synthetic polypeptide
  VH of XENP023623

SEQ ID NO: 478 - protein, 114 aa, Artificial Sequence
  Description of Artificial Sequence: Synthetic polypeptide
  VL of XENP023623
DVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 479 - protein, 5 aa, Artificial Sequence
  Description of Artificial Sequence: Synthetic peptide
  XENP023623 vhCDR1
HYGMN

SEQ ID NO: 480 - protein, 17 aa, Artificial Sequence
  Description of Artificial Sequence: Synthetic peptide
  XENP023623 vhCDR2
WINTYTGEPTYADGFTG

SEQ ID NO: 481 - protein, 8 aa, Artificial Sequence
  Description of Artificial Sequence: Synthetic peptide
  XENP023623 vhCDR3
DYYGSSPY

SEQ ID NO: 482 - protein, 16 aa, Artificial Sequence
  Description of Artificial Sequence: Synthetic peptide
  XENP023623 vlCDR1
KSSQSIVHSNGNTYLE

SEQ ID NO: 483 - protein, 7 aa, Artificial Sequence
  Description of Artificial Sequence: Synthetic peptide
  XENP023623 vlCDR2
KVSNRAS

SEQ ID NO: 484 - protein, 9 aa, Artificial Sequence
  Description of Artificial Sequence: Synthetic peptide
  XENP023623 vlCDR3
FQGSHVPNT

SEQ ID NO: 485 - protein, 251 aa, Artificial Sequence
  Description of Artificial Sequence: Synthetic polypeptide
  XENP023624 1C11_H3_L3.57_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 486 - protein, 117 aa, Artificial Sequence; identical to SEQ ID NO: 32
  Description of Artificial Sequence: Synthetic polypeptide
  VH of XENP023624

SEQ ID NO: 487 - protein, 114 aa, Artificial Sequence
  Description of Artificial Sequence: Synthetic polypeptide
  VL of XENP023624
DVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 488 - protein, 5 aa, Artificial Sequence
  Description of Artificial Sequence: Synthetic peptide
  XENP023624 vhCDR1
HYGMN

SEQ ID NO: 489 - protein, 17 aa, Artificial Sequence
  Description of Artificial Sequence: Synthetic peptide
  XENP023624 vhCDR2
WINTYTGEPTYADGFTG

SEQ ID NO: 490 - protein, 8 aa, Artificial Sequence
  Description of Artificial Sequence: Synthetic peptide
  XENP023624 vhCDR3
DYYGSSPY

SEQ ID NO: 491 - protein, 16 aa, Artificial Sequence
  Description of Artificial Sequence: Synthetic peptide
  XENP023624 vlCDR1
KSSQSIVHSNGNTYLE

SEQ ID NO: 492 - protein, 7 aa, Artificial Sequence
  Description of Artificial Sequence: Synthetic peptide
  XENP023624 vlCDR2
KVSNRFT

SEQ ID NO: 493 - protein, 9 aa, Artificial Sequence
  Description of Artificial Sequence: Synthetic peptide
  XENP023624 vlCDR3
FQGSHVPNT

SEQ ID NO: 494 - protein, 251 aa, Artificial Sequence
  Description of Artificial Sequence: Synthetic polypeptide
  XENP023625 1C11_H3_L3.58_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 495 - protein, 117 aa, Artificial Sequence; identical to SEQ ID NO: 32
  Description of Artificial Sequence: Synthetic polypeptide
  VH of XENP023625

SEQ ID NO: 496 - protein, 114 aa, Artificial Sequence
  Description of Artificial Sequence: Synthetic polypeptide
  VL of XENP023625
DVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 497 - protein, 5 aa, Artificial Sequence
  Description of Artificial Sequence: Synthetic peptide
  XENP023625 vhCDR1
HYGMN

SEQ ID NO: 498 - protein, 17 aa, Artificial Sequence
  Description of Artificial Sequence: Synthetic peptide
  XENP023625 vhCDR2
WINTYTGEPTYADGFTG

SEQ ID NO: 499 - protein, 8 aa, Artificial Sequence
  Description of Artificial Sequence: Synthetic peptide
  XENP023625 vhCDR3
DYYGSSPY

SEQ ID NO: 500 - protein, 16 aa, Artificial Sequence
  Description of Artificial Sequence: Synthetic peptide
  XENP023625 vlCDR1
KSSQSIVHSNGNTYLE

SEQ ID NO: 501 - protein, 7 aa, Artificial Sequence
  Description of Artificial Sequence: Synthetic peptide
  XENP023625 vlCDR2
KVSNRFS

SEQ ID NO: 502 - protein, 9 aa, Artificial Sequence
  Description of Artificial Sequence: Synthetic peptide
  XENP023625 vlCDR3
FQGSHVPNT

SEQ ID NO: 503 - protein, 251 aa, Artificial Sequence
  Description of Artificial Sequence: Synthetic polypeptide
  XENP023626 1C11_H3_L3.59_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 504 - protein, 117 aa, Artificial Sequence; identical to SEQ ID NO: 32
  Description of Artificial Sequence: Synthetic polypeptide
  VH of XENP023626

SEQ ID NO: 505 - protein, 114 aa, Artificial Sequence
  Description of Artificial Sequence: Synthetic polypeptide
  VL of XENP023626
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 506 - protein, 5 aa, Artificial Sequence
  Description of Artificial Sequence: Synthetic peptide
  XENP023626 vhCDR1
HYGMN

SEQ ID NO: 507 - protein, 17 aa, Artificial Sequence
  Description of Artificial Sequence: Synthetic peptide
  XENP023626 vhCDR2
WINTYTGEPTYADGFTG

SEQ ID NO: 508 - protein, 8 aa, Artificial Sequence
  Description of Artificial Sequence: Synthetic peptide
  XENP023626 vhCDR3
DYYGSSPY

SEQ ID NO: 509 - protein, 16 aa, Artificial Sequence
  Description of Artificial Sequence: Synthetic peptide
  XENP023626 vlCDR1
KSSQSIVHSNGNTYLE

SEQ ID NO: 510 - protein, 7 aa, Artificial Sequence
  Description of Artificial Sequence: Synthetic peptide
  XENP023626 vlCDR2
KVSNRFS

SEQ ID NO: 511 - protein, 9 aa, Artificial Sequence
  Description of Artificial Sequence: Synthetic peptide
  XENP023626 vlCDR3
FQGSHVPNT

SEQ ID NO: 512 - protein, 251 aa, Artificial Sequence
  Description of Artificial Sequence: Synthetic polypeptide
  XENP023627 1C11_H3_L3.60_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 513 - protein, 117 aa, Artificial Sequence; identical to SEQ ID NO: 32
  Description of Artificial Sequence: Synthetic polypeptide
  VH of XENP023627

SEQ ID NO: 514 - protein, 114 aa, Artificial Sequence
  Description of Artificial Sequence: Synthetic polypeptide
  VL of XENP023627
DVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 515 - protein, 5 aa, Artificial Sequence
  Description of Artificial Sequence: Synthetic peptide
  XENP023627 vhCDR1
HYGMN

SEQ ID NO: 516 - protein, 17 aa, Artificial Sequence
  Description of Artificial Sequence: Synthetic peptide
  XENP023627 vhCDR2
WINTYTGEPTYADGFTG

SEQ ID NO: 517 - protein, 8 aa, Artificial Sequence
  Description of Artificial Sequence: Synthetic peptide
  XENP023627 vhCDR3
DYYGSSPY

SEQ ID NO: 518 - protein, 16 aa, Artificial Sequence
  Description of Artificial Sequence: Synthetic peptide
  XENP023627 vlCDR1
KSSQSIVHSNGNTYLE

SEQ ID NO: 519 - protein, 7 aa, Artificial Sequence
  Description of Artificial Sequence: Synthetic peptide
  XENP023627 vlCDR2
KVSNRFS

SEQ ID NO: 520 - protein, 9 aa, Artificial Sequence
  Description of Artificial Sequence: Synthetic peptide
  XENP023627 vlCDR3
FQGSHVPNT

SEQ ID NO: 521 - protein, 251 aa, Artificial Sequence
  Description of Artificial Sequence: Synthetic polypeptide
  XENP023628 1C11_H3_L3.62_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 522 - protein, 117 aa, Artificial Sequence; identical to SEQ ID NO: 32
  Description of Artificial Sequence: Synthetic polypeptide
  VH of XENP023628

SEQ ID NO: 523 - protein, 114 aa, Artificial Sequence
  Description of Artificial Sequence: Synthetic polypeptide
  VL of XENP023628
DVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 524 - protein, 5 aa, Artificial Sequence
  Description of Artificial Sequence: Synthetic peptide
  XENP023628 vhCDR1
HYGMN

SEQ ID NO: 525 - protein, 17 aa, Artificial Sequence
  Description of Artificial Sequence: Synthetic peptide
  XENP023628 vhCDR2
WINTYTGEPTYADGFTG

SEQ ID NO: 526 - protein, 8 aa, Artificial Sequence
  Description of Artificial Sequence: Synthetic peptide
  XENP023628 vhCDR3
DYYGSSPY

SEQ ID NO: 527 - protein, 16 aa, Artificial Sequence
  Description of Artificial Sequence: Synthetic peptide
  XENP023628 vlCDR1
KSSQSIVHSNGNTYLE

SEQ ID NO: 528 - protein, 7 aa, Artificial Sequence
  Description of Artificial Sequence: Synthetic peptide
  XENP023628 vlCDR2
KVSNRFS

SEQ ID NO: 529 - protein, 9 aa, Artificial Sequence
  Description of Artificial Sequence: Synthetic peptide
  XENP023628 vlCDR3
FQGSHVPNT

SEQ ID NO: 530 - protein, 251 aa, Artificial Sequence
  Description of Artificial Sequence: Synthetic polypeptide
  XENP023629 1C11_H3_L3.63_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 531 - protein, 117 aa, Artificial Sequence; identical to SEQ ID NO: 32
  Description of Artificial Sequence: Synthetic polypeptide
  VH of XENP023629

SEQ ID NO: 532 - protein, 114 aa, Artificial Sequence
  Description of Artificial Sequence: Synthetic polypeptide
  VL of XENP023629
DVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 533 - protein, 5 aa, Artificial Sequence
  Description of Artificial Sequence: Synthetic peptide
  XENP023629 vhCDR1
HYGMN

SEQ ID NO: 534 - protein, 17 aa, Artificial Sequence
  Description of Artificial Sequence: Synthetic peptide
  XENP023629 vhCDR2
WINTYTGEPTYADGFTG

SEQ ID NO: 535 - protein, 8 aa, Artificial Sequence
  Description of Artificial Sequence: Synthetic peptide
  XENP023629 vhCDR3
DYYGSSPY

SEQ ID NO: 536 - protein, 16 aa, Artificial Sequence
  Description of Artificial Sequence: Synthetic peptide
  XENP023629 vlCDR1
KSSQSIVHSNGNTYLE

SEQ ID NO: 537 - protein, 7 aa, Artificial Sequence
  Description of Artificial Sequence: Synthetic peptide
  XENP023629 vlCDR2
KVSNRFS

SEQ ID NO: 538 - protein, 9 aa, Artificial Sequence
  Description of Artificial Sequence: Synthetic peptide
  XENP023629 vlCDR3
FQGSHVPNT

SEQ ID NO: 539 - protein, 251 aa, Artificial Sequence
  Description of Artificial Sequence: Synthetic polypeptide
  XENP023630 1C11_H3_L3.64_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 540 - protein, 117 aa, Artificial Sequence; identical to SEQ ID NO: 32
  Description of Artificial Sequence: Synthetic polypeptide
  VH of XENP023630

SEQ ID NO: 541 - protein, 114 aa, Artificial Sequence
  Description of Artificial Sequence: Synthetic polypeptide
  VL of XENP023630
DVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 542 - protein, 5 aa, Artificial Sequence
  Description of Artificial Sequence: Synthetic peptide
  XENP023630 vhCDR1
HYGMN

SEQ ID NO: 543 - protein, 17 aa, Artificial Sequence
  Description of Artificial Sequence: Synthetic peptide
  XENP023630 vhCDR2
WINTYTGEPTYADGFTG

SEQ ID NO: 544 - protein, 8 aa, Artificial Sequence
  Description of Artificial Sequence: Synthetic peptide
  XENP023630 vhCDR3
DYYGSSPY

SEQ ID NO: 545 - protein, 16 aa, Artificial Sequence
  Description of Artificial Sequence: Synthetic peptide
  XENP023630 vlCDR1
KSSQSIVHSNGNTYLE

SEQ ID NO: 546 - protein, 7 aa, Artificial Sequence
  Description of Artificial Sequence: Synthetic peptide
  XENP023630 vlCDR2
KVSNRFS

SEQ ID NO: 547 - protein, 9 aa, Artificial Sequence
  Description of Artificial Sequence: Synthetic peptide
  XENP023630 vlCDR3
FQGSHVPNT

SEQ ID NO: 548 - protein, 251 aa, Artificial Sequence
  Description of Artificial Sequence: Synthetic polypeptide
  XENP023631 1C11_H3_L3.65_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 549 - protein, 117 aa, Artificial Sequence; identical to SEQ ID NO: 32
  Description of Artificial Sequence: Synthetic polypeptide
  VH of XENP023631

SEQ ID NO: 550 - protein, 114 aa, Artificial Sequence
  Description of Artificial Sequence: Synthetic polypeptide
  VL of XENP023631
DVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 551 - protein, 5 aa, Artificial Sequence
  Description of Artificial Sequence: Synthetic peptide
  XENP023631 vhCDR1
HYGMN

SEQ ID NO: 552 - protein, 17 aa, Artificial Sequence
  Description of Artificial Sequence: Synthetic peptide
  XENP023631 vhCDR2
WINTYTGEPTYADGFTG

SEQ ID NO: 553 - protein, 8 aa, Artificial Sequence
  Description of Artificial Sequence: Synthetic peptide
  XENP023631 vhCDR3
DYYGSSPY

SEQ ID NO: 554 - protein, 16 aa, Artificial Sequence
  Description of Artificial Sequence: Synthetic peptide
  XENP023631 vlCDR1
KSSQSIVHSNGNTYLE

SEQ ID NO: 555 - protein, 7 aa, Artificial Sequence
  Description of Artificial Sequence: Synthetic peptide
  XENP023631 vlCDR2
KVSNRFS

SEQ ID NO: 556 - protein, 9 aa, Artificial Sequence
  Description of Artificial Sequence: Synthetic peptide
  XENP023631 vlCDR3
FQGSHVPNT

SEQ ID NO: 557 - protein, 251 aa, Artificial Sequence
  Description of Artificial Sequence: Synthetic polypeptide
  XENP023632 1C11_H3_L3.66_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 558 - protein, 117 aa, Artificial Sequence; identical to SEQ ID NO: 32
  Description of Artificial Sequence: Synthetic polypeptide
  VH of XENP023632

SEQ ID NO: 559 - protein, 114 aa, Artificial Sequence
  Description of Artificial Sequence: Synthetic polypeptide
  VL of XENP023632
DVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 560 - protein, 5 aa, Artificial Sequence
  Description of Artificial Sequence: Synthetic peptide
  XENP023632 vhCDR1
HYGMN

SEQ ID NO: 561 - protein, 17 aa, Artificial Sequence
  Description of Artificial Sequence: Synthetic peptide
  XENP023632 vhCDR2
WINTYTGEPTYADGFTG

SEQ ID NO: 562 - protein, 8 aa, Artificial Sequence
  Description of Artificial Sequence: Synthetic peptide
  XENP023632 vhCDR3
DYYGSSPY

SEQ ID NO: 563 - protein, 16 aa, Artificial Sequence
  Description of Artificial Sequence: Synthetic peptide
  XENP023632 vlCDR1
KSSQSIVHSNGNTYLE

SEQ ID NO: 564 - protein, 7 aa, Artificial Sequence
  Description of Artificial Sequence: Synthetic peptide
  XENP023632 vlCDR2
KVSNRFS

SEQ ID NO: 565 - protein, 9 aa, Artificial Sequence
  Description of Artificial Sequence: Synthetic peptide
  XENP023632 vlCDR3
FQGSHVPNT

SEQ ID NO: 566 - protein, 251 aa, Artificial Sequence
  Description of Artificial Sequence: Synthetic polypeptide
  XENP023633 1C11_H3_L3.69_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 567 - protein, 117 aa, Artificial Sequence; identical to SEQ ID NO: 32
  Description of Artificial Sequence: Synthetic polypeptide
  VH of XENP023633

SEQ ID NO: 568 - protein, 114 aa, Artificial Sequence
  Description of Artificial Sequence: Synthetic polypeptide
  VL of XENP023633
DVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 569 - protein, 5 aa, Artificial Sequence
  Description of Artificial Sequence: Synthetic peptide
  XENP023633 vhCDR1
HYGMN

SEQ ID NO: 570 - protein, 17 aa, Artificial Sequence
  Description of Artificial Sequence: Synthetic peptide
  XENP023633 vhCDR2
WINTYTGEPTYADGFTG

SEQ ID NO: 571 - protein, 8 aa, Artificial Sequence
  Description of Artificial Sequence: Synthetic peptide
  XENP023633 vhCDR3
DYYGSSPY

SEQ ID NO: 572 - protein, 16 aa, Artificial Sequence
  Description of Artificial Sequence: Synthetic peptide
  XENP023633 vlCDR1
KSSQSIVHSNGNTYLE

SEQ ID NO: 573 - protein, 7 aa, Artificial Sequence
  Description of Artificial Sequence: Synthetic peptide
  XENP023633 vlCDR2
KVSNRFS

SEQ ID NO: 574 - protein, 9 aa, Artificial Sequence
  Description of Artificial Sequence: Synthetic peptide
  XENP023633 vlCDR3
FQGSHVPNT

SEQ ID NO: 575 - protein, 251 aa, Artificial Sequence
  Description of Artificial Sequence: Synthetic polypeptide
  XENP023634 1C11_H3_L3.70_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 576 - protein, 117 aa, Artificial Sequence; identical to SEQ ID NO: 32
  Description of Artificial Sequence: Synthetic polypeptide
  VH of XENP023634

SEQ ID NO: 577 - protein, 114 aa, Artificial Sequence
  Description of Artificial Sequence: Synthetic polypeptide
  VL of XENP023634
DVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 578 - protein, 5 aa, Artificial Sequence
  Description of Artificial Sequence: Synthetic peptide
  XENP023634 vhCDR1
HYGMN

SEQ ID NO: 579 - protein, 17 aa, Artificial Sequence
  Description of Artificial Sequence: Synthetic peptide
  XENP023634 vhCDR2
WINTYTGEPTYADGFTG

SEQ ID NO: 580 - protein, 8 aa, Artificial Sequence
  Description of Artificial Sequence: Synthetic peptide
  XENP023634 vhCDR3
DYYGSSPY

SEQ ID NO: 581 - protein, 16 aa, Artificial Sequence
  Description of Artificial Sequence: Synthetic peptide
  XENP023634 vlCDR1
KSSQSIVHSNGNTYLE

SEQ ID NO: 582 - protein, 7 aa, Artificial Sequence
  Description of Artificial Sequence: Synthetic peptide
  XENP023634 vlCDR2
KVSNRFS

SEQ ID NO: 583 - protein, 9 aa, Artificial Sequence
  Description of Artificial Sequence: Synthetic peptide
  XENP023634 vlCDR3
FQGSHVPNT

SEQ ID NO: 584 - protein, 251 aa, Artificial Sequence
  Description of Artificial Sequence: Synthetic polypeptide
  XENP023635 1C11_H3_L3.72_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 585 - protein, 117 aa, Artificial Sequence; identical to SEQ ID NO: 32
  Description of Artificial Sequence: Synthetic polypeptide
  VH of XENP023635

SEQ ID NO: 586 - protein, 114 aa, Artificial Sequence
  Description of Artificial Sequence: Synthetic polypeptide
  VL of XENP023635
DVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 587 - protein, 5 aa, Artificial Sequence
  Description of Artificial Sequence: Synthetic peptide
  XENP023635 vhCDR1
HYGMN

SEQ ID NO: 588 - protein, 17 aa, Artificial Sequence
  Description of Artificial Sequence: Synthetic peptide
  XENP023635 vhCDR2
WINTYTGEPTYADGFTG

SEQ ID NO: 589 - protein, 8 aa, Artificial Sequence
  Description of Artificial Sequence: Synthetic peptide
  XENP023635 vhCDR3
DYYGSSPY

SEQ ID NO: 590 - protein, 16 aa, Artificial Sequence
  Description of Artificial Sequence: Synthetic peptide
  XENP023635 vlCDR1
KSSQSIVHSNGNTYLE

SEQ ID NO: 591 - protein, 7 aa, Artificial Sequence
  Description of Artificial Sequence: Synthetic peptide
  XENP023635 vlCDR2
KVSNRFS

SEQ ID NO: 592 - protein, 9 aa, Artificial Sequence
  Description of Artificial Sequence: Synthetic peptide
  XENP023635 vlCDR3
FQGSHVPNT

SEQ ID NO: 593 - protein, 251 aa, Artificial Sequence
  Description of Artificial Sequence: Synthetic polypeptide
  XENP023636 1C11_H3_L3.73_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 594 - protein, 117 aa, Artificial Sequence; identical to SEQ ID NO: 32
  Description of Artificial Sequence: Synthetic polypeptide
  VH of XENP023636

SEQ ID NO: 595 - protein, 114 aa, Artificial Sequence
  Description of Artificial Sequence: Synthetic polypeptide
  VL of XENP023636
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 596 - protein, 5 aa, Artificial Sequence
  Description of Artificial Sequence: Synthetic peptide
  XENP023636 vhCDR1
HYGMN

SEQ ID NO: 597 - protein, 17 aa, Artificial Sequence
  Description of Artificial Sequence: Synthetic peptide
  XENP023636 vhCDR2
WINTYTGEPTYADGFTG

SEQ ID NO: 598 - protein, 8 aa, Artificial Sequence
  Description of Artificial Sequence: Synthetic peptide
  XENP023636 vhCDR3
DYYGSSPY

SEQ ID NO: 599 - protein, 16 aa, Artificial Sequence
  Description of Artificial Sequence: Synthetic peptide
  XENP023636 vlCDR1
KSSQSIVHSNGNTYLE

SEQ ID NO: 600 - protein, 7 aa, Artificial Sequence
  Description of Artificial Sequence: Synthetic peptide
  XENP023636 vlCDR2
KVSNRFS

SEQ ID NO: 601 - protein, 9 aa, Artificial Sequence
  Description of Artificial Sequence: Synthetic peptide
  XENP023636 vlCDR3
FQGSHVPNT

SEQ ID NO: 602 - protein, 251 aa, Artificial Sequence
  Description of Artificial Sequence: Synthetic polypeptide
  XENP023637 1C11_H3_L3.75_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 603 - protein, 117 aa, Artificial Sequence; identical to SEQ ID NO: 32
  Description of Artificial Sequence: Synthetic polypeptide
  VH of XENP023637

SEQ ID NO: 604 - protein, 114 aa, Artificial Sequence
  Description of Artificial Sequence: Synthetic polypeptide
  VL of XENP023637
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 605 - protein, 5 aa, Artificial Sequence
  Description of Artificial Sequence: Synthetic peptide
  XENP023637 vhCDR1
HYGMN

SEQ ID NO: 606 - protein, 17 aa, Artificial Sequence
  Description of Artificial Sequence: Synthetic peptide
  XENP023637 vhCDR2
WINTYTGEPTYADGFTG

SEQ ID NO: 607 - protein, 8 aa, Artificial Sequence
  Description of Artificial Sequence: Synthetic peptide
  XENP023637 vhCDR3
DYYGSSPY

SEQ ID NO: 608 - protein, 16 aa, Artificial Sequence
  Description of Artificial Sequence: Synthetic peptide
  XENP023637 vlCDR1
KSSQSIVHSNGNTYLE

SEQ ID NO: 609 - protein, 7 aa, Artificial Sequence
  Description of Artificial Sequence: Synthetic peptide
  XENP023637 vlCDR2
KVSNRFS

SEQ ID NO: 610 - protein, 9 aa, Artificial Sequence
  Description of Artificial Sequence: Synthetic peptide
  XENP023637 vlCDR3
LQGSHVPNT

SEQ ID NO: 611 - protein, 251 aa, Artificial Sequence
  Description of Artificial Sequence: Synthetic polypeptide
  XENP023638 1C11_H3_L3.78_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 612 - protein, 117 aa, Artificial Sequence; identical to SEQ ID NO: 32
  Description of Artificial Sequence: Synthetic polypeptide
  VH of XENP023638

SEQ ID NO: 613 - protein, 114 aa, Artificial Sequence
  Description of Artificial Sequence: Synthetic polypeptide
  VL of XENP023638
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 614 - protein, 5 aa, Artificial Sequence
  Description of Artificial Sequence: Synthetic peptide
  XENP023638 vhCDR1
HYGMN

SEQ ID NO: 615 - protein, 17 aa, Artificial Sequence
  Description of Artificial Sequence: Synthetic peptide
  XENP023638 vhCDR2
WINTYTGEPTYADGFTG

SEQ ID NO: 616 - protein, 8 aa, Artificial Sequence
  Description of Artificial Sequence: Synthetic peptide
  XENP023638 vhCDR3
DYYGSSPY

SEQ ID NO: 617 - protein, 16 aa, Artificial Sequence
  Description of Artificial Sequence: Synthetic peptide
  XENP023638 vlCDR1
KSSQSIVHSNGNTYLE

SEQ ID NO: 618 - protein, 7 aa, Artificial Sequence
  Description of Artificial Sequence: Synthetic peptide
  XENP023638 vlCDR2
KVSNRFS

SEQ ID NO: 619 - protein, 9 aa, Artificial Sequence
  Description of Artificial Sequence: Synthetic peptide
  XENP023638 vlCDR3
FQGSHVGNT

SEQ ID NO: 620 - protein, 251 aa, Artificial Sequence
  Description of Artificial Sequence: Synthetic polypeptide
  XENP023639 1C11_H3_L3.79_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 621 - protein, 117 aa, Artificial Sequence; identical to SEQ ID NO: 32
  Description of Artificial Sequence: Synthetic polypeptide
  VH of XENP023639

SEQ ID NO: 622 - protein, 114 aa, Artificial Sequence
  Description of Artificial Sequence: Synthetic polypeptide
  VL of XENP023639
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 623 - protein, 5 aa, Artificial Sequence
  Description of Artificial Sequence: Synthetic peptide
  XENP023639 vhCDR1
HYGMN

SEQ ID NO: 624 - protein, 17 aa, Artificial Sequence
  Description of Artificial Sequence: Synthetic peptide
  XENP023639 vhCDR2
WINTYTGEPTYADGFTG

SEQ ID NO: 625 - protein, 8 aa, Artificial Sequence
  Description of Artificial Sequence: Synthetic peptide
  XENP023639 vhCDR3
DYYGSSPY

SEQ ID NO: 626 - protein, 16 aa, Artificial Sequence
  Description of Artificial Sequence: Synthetic peptide
  XENP023639 vlCDR1
KSSQSIVHSNGNTYLE

SEQ ID NO: 627 - protein, 7 aa, Artificial Sequence
  Description of Artificial Sequence: Synthetic peptide
  XENP023639 vlCDR2
KVSNRFS

SEQ ID NO: 628 - protein, 9 aa, Artificial Sequence
  Description of Artificial Sequence: Synthetic peptide
  XENP023639 vlCDR3
FQGSHVHNT

SEQ ID NO: 629 - protein, 251 aa, Artificial Sequence
  Description of Artificial Sequence: Synthetic polypeptide
  XENP023640 1C11_H3_L3.81_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 630 - protein, 117 aa, Artificial Sequence; identical to SEQ ID NO: 32
  Description of Artificial Sequence: Synthetic polypeptide
  VH of XENP023640

SEQ ID NO: 631 - protein, 114 aa, Artificial Sequence
  Description of Artificial Sequence: Synthetic polypeptide
  VL of XENP023640
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 632 - protein, 5 aa, Artificial Sequence
  Description of Artificial Sequence: Synthetic peptide
  XENP023640 vhCDR1
HYGMN

SEQ ID NO: 633 - protein, 17 aa, Artificial Sequence
  Description of Artificial Sequence: Synthetic peptide
  XENP023640 vhCDR2
WINTYTGEPTYADGFTG

SEQ ID NO: 634 - protein, 8 aa, Artificial Sequence
  Description of Artificial Sequence: Synthetic peptide
  XENP023640 vhCDR3
DYYGSSPY

SEQ ID NO: 635 - protein, 16 aa, Artificial Sequence
  Description of Artificial Sequence: Synthetic peptide
  XENP023640 vlCDR1
KSSQSIVHSNGNTYLE

SEQ ID NO: 636 - protein, 7 aa, Artificial Sequence
  Description of Artificial Sequence: Synthetic peptide
  XENP023640 vlCDR2
KVSNRFS

SEQ ID NO: 637 - protein, 9 aa, Artificial Sequence
  Description of Artificial Sequence: Synthetic peptide
  XENP023640 vlCDR3
FQGSHVPNT

SEQ ID NO: 638 - protein, 251 aa, Artificial Sequence
  Description of Artificial Sequence: Synthetic polypeptide
  XENP023641 1C11_H3_L3.82_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 639 - protein, 117 aa, Artificial Sequence; identical to SEQ ID NO: 32
  Description of Artificial Sequence: Synthetic polypeptide
  VH of XENP023641

SEQ ID NO: 640 - protein, 114 aa, Artificial Sequence
  Description of Artificial Sequence: Synthetic polypeptide
  VL of XENP023641
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 641 - protein, 5 aa, Artificial Sequence
  Description of Artificial Sequence: Synthetic peptide
  XENP023641 vhCDR1
HYGMN

SEQ ID NO: 642 - protein, 17 aa, Artificial Sequence
  Description of Artificial Sequence: Synthetic peptide
  XENP023641 vhCDR2
WINTYTGEPTYADGFTG

SEQ ID NO: 643 - protein, 8 aa, Artificial Sequence
  Description of Artificial Sequence: Synthetic peptide
  XENP023641 vhCDR3
DYYGSSPY

SEQ ID NO: 644 - protein, 16 aa, Artificial Sequence
  Description of Artificial Sequence: Synthetic peptide
  XENP023641 vlCDR1
KSSQSIVHSNGNTYLE

SEQ ID NO: 645 - protein, 7 aa, Artificial Sequence
  Description of Artificial Sequence: Synthetic peptide
  XENP023641 vlCDR2
KVSNRFS

SEQ ID NO: 646 - protein, 9 aa, Artificial Sequence
  Description of Artificial Sequence: Synthetic peptide
  XENP023641 vlCDR3
FQGSHVPNT

SEQ ID NO: 647 - protein, 251 aa, Artificial Sequence
  Description of Artificial Sequence: Synthetic polypeptide
  XENP023755 1C11_H3.1_L3_scFv
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 648 - protein, 117 aa, Artificial Sequence
  Description of Artificial Sequence: Synthetic polypeptide
  VH of XENP023755
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 649 - protein, 114 aa, Artificial Sequence
  Description of Artificial Sequence: Synthetic polypeptide
  VL of XENP023755
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 650 - protein, 5 aa, Artificial Sequence
  Description of Artificial Sequence: Synthetic peptide
  XENP023755 vhCDR1
HYGMN

SEQ ID NO: 651 - protein, 17 aa, Artificial Sequence
  Description of Artificial Sequence: Synthetic peptide
  XENP023755 vhCDR2
WINTYTGEPTYADGFTG

SEQ ID NO: 652 - protein, 8 aa, Artificial Sequence
  Description of Artificial Sequence: Synthetic peptide
  XENP023755 vhCDR3
DYYGSSPY

SEQ ID NO: 653 - protein, 16 aa, Artificial Sequence
  Description of Artificial Sequence: Synthetic peptide
  XENP023755 vlCDR1
KSSQSIVHSNGNTYLE

SEQ ID NO: 654 - protein, 7 aa, Artificial Sequence
  Description of Artificial Sequence: Synthetic peptide
  XENP023755 vlCDR2
KVSNRFS

SEQ ID NO: 655 - protein, 9 aa, Artificial Sequence
  Description of Artificial Sequence: Synthetic peptide
  XENP023755 vlCDR3
FQGSHVPNT

SEQ ID NO: 656 - protein, 251 aa, Artificial Sequence
  Description of Artificial Sequence: Synthetic polypeptide
  XENP023756 1C11_H3.2_L3_scFv
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 657 - protein, 117 aa, Artificial Sequence
  Description of Artificial Sequence: Synthetic polypeptide
  VH of XENP023756
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 658 - protein, 114 aa, Artificial Sequence; identical to SEQ ID NO: 649
  Description of Artificial Sequence: Synthetic polypeptide
  VL of XENP023756

SEQ ID NO: 659 - protein, 5 aa, Artificial Sequence
  Description of Artificial Sequence: Synthetic peptide
  XENP023756 vhCDR1
HYGMN

SEQ ID NO: 660 - protein, 17 aa, Artificial Sequence
  Description of Artificial Sequence: Synthetic peptide
  XENP023756 vhCDR2
WINTYTGEPTYADGFTG

SEQ ID NO: 661 - protein, 8 aa, Artificial Sequence
  Description of Artificial Sequence: Synthetic peptide
  XENP023756 vhCDR3
DYYGSSPY

SEQ ID NO: 662 - protein, 16 aa, Artificial Sequence
  Description of Artificial Sequence: Synthetic peptide
  XENP023756 vlCDR1
KSSQSIVHSNGNTYLE

SEQ ID NO: 663 - protein, 7 aa, Artificial Sequence
  Description of Artificial Sequence: Synthetic peptide
  XENP023756 vlCDR2
KVSNRFS

SEQ ID NO: 664 - protein, 9 aa, Artificial Sequence
  Description of Artificial Sequence: Synthetic peptide
  XENP023756 vlCDR3
FQGSHVPNT

SEQ ID NO: 665 - protein, 251 aa, Artificial Sequence
  Description of Artificial Sequence: Synthetic polypeptide
  XENP023757 1C11_H3.4_L3_scFv
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 666 - protein, 117 aa, Artificial Sequence
  Description of Artificial Sequence: Synthetic polypeptide
  VH of XENP023757
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 667 - protein, 114 aa, Artificial Sequence; identical to SEQ ID NO: 649
  Description of Artificial Sequence: Synthetic polypeptide
  VL of XENP023757

SEQ ID NO: 668 - protein, 5 aa, Artificial Sequence
  Description of Artificial Sequence: Synthetic peptide
  XENP023757 vhCDR1
HYGMN

SEQ ID NO: 669 - protein, 17 aa, Artificial Sequence
  Description of Artificial Sequence: Synthetic peptide
  XENP023757 vhCDR2
WINTYTGEPTYADGFTG

SEQ ID NO: 670 - protein, 8 aa, Artificial Sequence
  Description of Artificial Sequence: Synthetic peptide
  XENP023757 vhCDR3
DYYGSSPY

SEQ ID NO: 671 - protein, 16 aa, Artificial Sequence
  Description of Artificial Sequence: Synthetic peptide
  XENP023757 vlCDR1
KSSQSIVHSNGNTYLE

SEQ ID NO: 672 - protein, 7 aa, Artificial Sequence
  Description of Artificial Sequence: Synthetic peptide
  XENP023757 vlCDR2
KVSNRFS

SEQ ID NO: 673 - protein, 9 aa, Artificial Sequence
  Description of Artificial Sequence: Synthetic peptide
  XENP023757 vlCDR3
FQGSHVPNT

SEQ ID NO: 674 - protein, 251 aa, Artificial Sequence
  Description of Artificial Sequence: Synthetic polypeptide
  XENP023758 1C11_H3.5_L3_scFv
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 675 - protein, 117 aa, Artificial Sequence
  Description of Artificial Sequence: Synthetic polypeptide
  VH of XENP023758
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 676 - protein, 114 aa, Artificial Sequence; identical to SEQ ID NO: 649
  Description of Artificial Sequence: Synthetic polypeptide
  VL of XENP023758

SEQ ID NO: 677 - protein, 5 aa, Artificial Sequence
  Description of Artificial Sequence: Synthetic peptide
  XENP023758 vhCDR1
HYGMN

SEQ ID NO: 678 - protein, 17 aa, Artificial Sequence
  Description of Artificial Sequence: Synthetic peptide
  XENP023758 vhCDR2
WINTYTGEPTYADGFTG

SEQ ID NO: 679 - protein, 8 aa, Artificial Sequence
  Description of Artificial Sequence: Synthetic peptide
  XENP023758 vhCDR3
DYYGSSPY

SEQ ID NO: 680 - protein, 16 aa, Artificial Sequence
  Description of Artificial Sequence: Synthetic peptide
  XENP023758 vlCDR1
KSSQSIVHSNGNTYLE

SEQ ID NO: 681 - protein, 7 aa, Artificial Sequence
  Description of Artificial Sequence: Synthetic peptide
  XENP023758 vlCDR2
KVSNRFS

SEQ ID NO: 682 - protein, 9 aa, Artificial Sequence
  Description of Artificial Sequence: Synthetic peptide
  XENP023758 vlCDR3
FQGSHVPNT

SEQ ID NO: 683 - protein, 251 aa, Artificial Sequence
  Description of Artificial Sequence: Synthetic polypeptide
  XENP023759 1C11_H3.6_L3_scFv
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 684 - protein, 117 aa, Artificial Sequence
  Description of Artificial Sequence: Synthetic polypeptide
  VH of XENP023759
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 685 - protein, 114 aa, Artificial Sequence; identical to SEQ ID NO: 649
  Description of Artificial Sequence: Synthetic polypeptide
  VL of XENP023759

SEQ ID NO: 686 - protein, 5 aa, Artificial Sequence
  Description of Artificial Sequence: Synthetic peptide
  XENP023759 vhCDR1
HYGMN

SEQ ID NO: 687 - protein, 17 aa, Artificial Sequence
  Description of Artificial Sequence: Synthetic peptide
  XENP023759 vhCDR2
WINTYTGEPTYADGFTG

SEQ ID NO: 688 - protein, 8 aa, Artificial Sequence
  Description of Artificial Sequence: Synthetic peptide
  XENP023759 vhCDR3
DYYGSSPY

SEQ ID NO: 689 - protein, 16 aa, Artificial Sequence
  Description of Artificial Sequence: Synthetic peptide
  XENP023759 vlCDR1
KSSQSIVHSNGNTYLE

SEQ ID NO: 690 - protein, 7 aa, Artificial Sequence
  Description of Artificial Sequence: Synthetic peptide
  XENP023759 vlCDR2
KVSNRFS

SEQ ID NO: 691 - protein, 9 aa, Artificial Sequence
  Description of Artificial Sequence: Synthetic peptide
  XENP023759 vlCDR3
FQGSHVPNT

SEQ ID NO: 692 - protein, 251 aa, Artificial Sequence
  Description of Artificial Sequence: Synthetic polypeptide
  XENP023760 1C11_H3.7_L3_scFv
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 693 - protein, 117 aa, Artificial Sequence
  Description of Artificial Sequence: Synthetic polypeptide
  VH of XENP023760
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 694 - protein, 114 aa, Artificial Sequence; identical to SEQ ID NO: 649
  Description of Artificial Sequence: Synthetic polypeptide
  VL of XENP023760

SEQ ID NO: 695 - protein, 5 aa, Artificial Sequence
  Description of Artificial Sequence: Synthetic peptide
  XENP023760 vhCDR1
HYGMN

SEQ ID NO: 696 - protein, 17 aa, Artificial Sequence
  Description of Artificial Sequence: Synthetic peptide
  XENP023760 vhCDR2
WINTYTGEPTYADGFTG

SEQ ID NO: 697 - protein, 8 aa, Artificial Sequence
  Description of Artificial Sequence: Synthetic peptide
  XENP023760 vhCDR3
DYYGSSPY

SEQ ID NO: 698 - protein, 16 aa, Artificial Sequence
  Description of Artificial Sequence: Synthetic peptide
  XENP023760 vlCDR1
KSSQSIVHSNGNTYLE

SEQ ID NO: 699 - protein, 7 aa, Artificial Sequence
  Description of Artificial Sequence: Synthetic peptide
  XENP023760 vlCDR2
KVSNRFS

SEQ ID NO: 700 - protein, 9 aa, Artificial Sequence
  Description of Artificial Sequence: Synthetic peptide
  XENP023760 vlCDR3
FQGSHVPNT

SEQ ID NO: 701 - protein, 251 aa, Artificial Sequence
  Description of Artificial Sequence: Synthetic polypeptide
  XENP023761 1C11_H3.8_L3_scFv
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 702 - protein, 117 aa, Artificial Sequence
  Description of Artificial Sequence: Synthetic polypeptide
  VH of XENP023761
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 703 - protein, 114 aa, Artificial Sequence; identical to SEQ ID NO: 649
  Description of Artificial Sequence: Synthetic polypeptide
  VL of XENP023761

SEQ ID NO: 704 - protein, 5 aa, Artificial Sequence
  Description of Artificial Sequence: Synthetic peptide
  XENP023761 vhCDR1
HYGMN

SEQ ID NO: 705 - protein, 17 aa, Artificial Sequence
  Description of Artificial Sequence: Synthetic peptide
  XENP023761 vhCDR2
WINTYTGEPTYADGFTG

SEQ ID NO: 706 - protein, 8 aa, Artificial Sequence
  Description of Artificial Sequence: Synthetic peptide
  XENP023761 vhCDR3
DYYGSSPY

SEQ ID NO: 707 - protein, 16 aa, Artificial Sequence
  Description of Artificial Sequence: Synthetic peptide
  XENP023761 vlCDR1
KSSQSIVHSNGNTYLE

SEQ ID NO: 708 - protein, 7 aa, Artificial Sequence
  Description of Artificial Sequence: Synthetic peptide
  XENP023761 vlCDR2
KVSNRFS

SEQ ID NO: 709 - protein, 9 aa, Artificial Sequence
  Description of Artificial Sequence: Synthetic peptide
  XENP023761 vlCDR3
FQGSHVPNT

SEQ ID NO: 710 - protein, 251 aa, Artificial Sequence
  Description of Artificial Sequence: Synthetic polypeptide
  XENP023762 1C11_H3.11_L3_scFv
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 711 - protein, 117 aa, Artificial Sequence
  Description of Artificial Sequence: Synthetic polypeptide
  VH of XENP023762
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 712 - protein, 114 aa, Artificial Sequence; identical to SEQ ID NO: 649
  Description of Artificial Sequence: Synthetic polypeptide
  VL of XENP023762

SEQ ID NO: 713 - protein, 5 aa, Artificial Sequence
  Description of Artificial Sequence: Synthetic peptide
  XENP023762 vhCDR1
HYGMN

SEQ ID NO: 714 - protein, 17 aa, Artificial Sequence
  Description of Artificial Sequence: Synthetic peptide
  XENP023762 vhCDR2
WINTYTGEPTYADGFTG

SEQ ID NO: 715 - protein, 8 aa, Artificial Sequence
  Description of Artificial Sequence: Synthetic peptide
  XENP023762 vhCDR3
DYYGSSPY

SEQ ID NO: 716 - protein, 16 aa, Artificial Sequence
  Description of Artificial Sequence: Synthetic peptide
  XENP023762 vlCDR1
KSSQSIVHSNGNTYLE

SEQ ID NO: 717 - protein, 7 aa, Artificial Sequence
  Description of Artificial Sequence: Synthetic peptide
  XENP023762 vlCDR2
KVSNRFS

SEQ ID NO: 718 - protein, 9 aa, Artificial Sequence
  Description of Artificial Sequence: Synthetic peptide
  XENP023762 vlCDR3
FQGSHVPNT

SEQ ID NO: 719 - protein, 251 aa, Artificial Sequence
  Description of Artificial Sequence: Synthetic polypeptide
  XENP023763 1C11_H3.12_L3_scFv
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 720 - protein, 117 aa, Artificial Sequence
  Description of Artificial Sequence: Synthetic polypeptide
  VH of XENP023763
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 721 - protein, 114 aa, Artificial Sequence; identical to SEQ ID NO: 649
  Description of Artificial Sequence: Synthetic polypeptide
  VL of XENP023763

SEQ ID NO: 722 - protein, 5 aa, Artificial Sequence
  Description of Artificial Sequence: Synthetic peptide
  XENP023763 vhCDR1
HYGMN

SEQ ID NO: 723 - protein, 17 aa, Artificial Sequence
  Description of Artificial Sequence: Synthetic peptide
  XENP023763 vhCDR2
WINTYTGEPTYADGFTG

SEQ ID NO: 724 - protein, 8 aa, Artificial Sequence
  Description of Artificial Sequence: Synthetic peptide
  XENP023763 vhCDR3
DYYGSSPY

SEQ ID NO: 725 - protein, 16 aa, Artificial Sequence
  Description of Artificial Sequence: Synthetic peptide
  XENP023763 vlCDR1
KSSQSIVHSNGNTYLE

SEQ ID NO: 726 - protein, 7 aa, Artificial Sequence
  Description of Artificial Sequence: Synthetic peptide
  XENP023763 vlCDR2
KVSNRFS

SEQ ID NO: 727 - protein, 9 aa, Artificial Sequence
  Description of Artificial Sequence: Synthetic peptide
  XENP023763 vlCDR3
FQGSHVPNT

SEQ ID NO: 728 - protein, 251 aa, Artificial Sequence
  Description of Artificial Sequence: Synthetic polypeptide
  XENP023764 1C11_H3.16_L3_scFv
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 729 - protein, 117 aa, Artificial Sequence
  Description of Artificial Sequence: Synthetic polypeptide
  VH of XENP023764
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 730 - protein, 114 aa, Artificial Sequence; identical to SEQ ID NO: 649
  Description of Artificial Sequence: Synthetic polypeptide
  VL of XENP023764

SEQ ID NO: 731 - protein, 5 aa, Artificial Sequence
  Description of Artificial Sequence: Synthetic peptide
  XENP023764 vhCDR1
HYAMN

SEQ ID NO: 732 - protein, 17 aa, Artificial Sequence
  Description of Artificial Sequence: Synthetic peptide
  XENP023764 vhCDR2
WINTYTGEPTYADGFTG

SEQ ID NO: 733 - protein, 8 aa, Artificial Sequence
  Description of Artificial Sequence: Synthetic peptide
  XENP023764 vhCDR3
DYYGSSPY

SEQ ID NO: 734 - protein, 16 aa, Artificial Sequence
  Description of Artificial Sequence: Synthetic peptide
  XENP023764 vlCDR1
KSSQSIVHSNGNTYLE

SEQ ID NO: 735 - protein, 7 aa, Artificial Sequence
  Description of Artificial Sequence: Synthetic peptide
  XENP023764 vlCDR2
KVSNRFS

SEQ ID NO: 736 - protein, 9 aa, Artificial Sequence
  Description of Artificial Sequence: Synthetic peptide
  XENP023764 vlCDR3
FQGSHVPNT

SEQ ID NO: 737 - protein, 251 aa, Artificial Sequence
  Description of Artificial Sequence: Synthetic polypeptide
  XENP023765 1C11_H3.18_L3_scFv
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 738 - protein, 117 aa, Artificial Sequence
  Description of Artificial Sequence: Synthetic polypeptide
  VH of XENP023765
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSS

SEQ ID NO: 739 - protein, 114 aa, Artificial Sequence; identical to SEQ ID NO: 649
  Description of Artificial Sequence: Synthetic polypeptide
  VL of XENP023765

SEQ ID NO: 740 - protein, 5 aa, Artificial Sequence
  Description of Artificial Sequence: Synthetic peptide
  XENP023765 vhCDR1
HYGMN

SEQ ID NO: 741 - protein, 17 aa, Artificial Sequence
  Description of Artificial Sequence: Synthetic peptide
  XENP023765 vhCDR2
WINTYTGEPTYADGFTG

SEQ ID NO: 742 - protein, 8 aa, Artificial Sequence
  Description of Artificial Sequence: Synthetic peptide
  XENP023765 vhCDR3
DYYGSSPY

SEQ ID NO: 743 - protein, 16 aa, Artificial Sequence
  Description of Artificial Sequence: Synthetic peptide
  XENP023765 vlCDR1
KSSQSIVHSNGNTYLE

SEQ ID NO: 744 - protein, 7 aa, Artificial Sequence
  Description of Artificial Sequence: Synthetic peptide
  XENP023765 vlCDR2
KVSNRFS

SEQ ID NO: 745 - protein, 9 aa, Artificial Sequence
  Description of Artificial Sequence: Synthetic peptide
  XENP023765 vlCDR3
FQGSHVPNT

SEQ ID NO: 746 - protein, 251 aa, Artificial Sequence
  Description of Artificial Sequence: Synthetic polypeptide
  XENP023766 1C11_H3.19_L3_scFv
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 747 - protein, 117 aa, Artificial Sequence
  Description of Artificial Sequence: Synthetic polypeptide
  VH of XENP023766
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSS

SEQ ID NO: 748 - protein, 114 aa, Artificial Sequence; identical to SEQ ID NO: 649
  Description of Artificial Sequence: Synthetic polypeptide
  VL of XENP023766

SEQ ID NO: 749 - protein, 5 aa, Artificial Sequence
  Description of Artificial Sequence: Synthetic peptide
  XENP023766 vhCDR1
HYGMN

SEQ ID NO: 750 - protein, 17 aa, Artificial Sequence
  Description of Artificial Sequence: Synthetic peptide
  XENP023766 vhCDR2
WINTYTGEPTYADGFTG

SEQ ID NO: 751 - protein, 8 aa, Artificial Sequence
  Description of Artificial Sequence: Synthetic peptide
  XENP023766 vhCDR3
DYYGSSPY

SEQ ID NO: 752 - protein, 16 aa, Artificial Sequence
  Description of Artificial Sequence: Synthetic peptide
  XENP023766 vlCDR1
KSSQSIVHSNGNTYLE

SEQ ID NO: 753 - protein, 7 aa, Artificial Sequence
  Description of Artificial Sequence: Synthetic peptide
  XENP023766 vlCDR2
KVSNRFS

SEQ ID NO: 754 - protein, 9 aa, Artificial Sequence
  Description of Artificial Sequence: Synthetic peptide
  XENP023766 vlCDR3
FQGSHVPNT

SEQ ID NO: 755 - protein, 251 aa, Artificial Sequence
  Description of Artificial Sequence: Synthetic polypeptide
  XENP023767 1C11_H3.20_L3_scFv
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 756 - protein, 117 aa, Artificial Sequence
  Description of Artificial Sequence: Synthetic polypeptide
  VH of XENP023767
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSS

SEQ ID NO: 757 - protein, 114 aa, Artificial Sequence; identical to SEQ ID NO: 649
  Description of Artificial Sequence: Synthetic polypeptide
  VL of XENP023767

SEQ ID NO: 758 - protein, 5 aa, Artificial Sequence
  Description of Artificial Sequence: Synthetic peptide
  XENP023767 vhCDR1
HYGMN

SEQ ID NO: 759 - protein, 17 aa, Artificial Sequence
  Description of Artificial Sequence: Synthetic peptide
  XENP023767 vhCDR2
WINTYTGEPTYADGFTG

SEQ ID NO: 760 - protein, 8 aa, Artificial Sequence
  Description of Artificial Sequence: Synthetic peptide
  XENP023767 vhCDR3
DYYGSSPY

SEQ ID NO: 761 - protein, 16 aa, Artificial Sequence
  Description of Artificial Sequence: Synthetic peptide
  XENP023767 vlCDR1
KSSQSIVHSNGNTYLE

SEQ ID NO: 762 - protein, 7 aa, Artificial Sequence
  Description of Artificial Sequence: Synthetic peptide
  XENP023767 vlCDR2
KVSNRFS

SEQ ID NO: 763 - protein, 9 aa, Artificial Sequence
  Description of Artificial Sequence: Synthetic peptide
  XENP023767 vlCDR3
FQGSHVPNT

SEQ ID NO: 764 - protein, 251 aa, Artificial Sequence
  Description of Artificial Sequence: Synthetic polypeptide
  XENP023768 1C11_H3.21_L3_scFv
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 765 - protein, 117 aa, Artificial Sequence
  Description of Artificial Sequence: Synthetic polypeptide
  VH of XENP023768
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSS

SEQ ID NO: 766 - protein, 114 aa, Artificial Sequence; identical to SEQ ID NO: 649
  Description of Artificial Sequence: Synthetic polypeptide
  VL of XENP023768

SEQ ID NO: 767 - protein, 5 aa, Artificial Sequence
  Description of Artificial Sequence: Synthetic peptide
  XENP023768 vhCDR1
HYGMN

SEQ ID NO: 768 - protein, 17 aa, Artificial Sequence
  Description of Artificial Sequence: Synthetic peptide
  XENP023768 vhCDR2
WINTYTGEPTYADGFTG

SEQ ID NO: 769 - protein, 8 aa, Artificial Sequence
  Description of Artificial Sequence: Synthetic peptide
  XENP023768 vhCDR3
DYYGSSPY

SEQ ID NO: 770 - protein, 16 aa, Artificial Sequence
  Description of Artificial Sequence: Synthetic peptide
  XENP023768 vlCDR1
KSSQSIVHSNGNTYLE

SEQ ID NO: 771 - protein, 7 aa, Artificial Sequence
  Description of Artificial Sequence: Synthetic peptide
  XENP023768 vlCDR2
KVSNRFS

SEQ ID NO: 772 - protein, 9 aa, Artificial Sequence
  Description of Artificial Sequence: Synthetic peptide
  XENP023768 vlCDR3
FQGSHVPNT

SEQ ID NO: 773 - protein, 251 aa, Artificial Sequence
  Description of Artificial Sequence: Synthetic polypeptide
  XENP023769 1C11_H3.22_L3_scFv
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 774 - protein, 117 aa, Artificial Sequence
  Description of Artificial Sequence: Synthetic polypeptide
  VH of XENP023769
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSS

SEQ ID NO: 775 - protein, 114 aa, Artificial Sequence; identical to SEQ ID NO: 649
  Description of Artificial Sequence: Synthetic polypeptide
  VL of XENP023769

SEQ ID NO: 776 - protein, 5 aa, Artificial Sequence
  Description of Artificial Sequence: Synthetic peptide
  XENP023769 vhCDR1
HYGMN

SEQ ID NO: 777 - protein, 17 aa, Artificial Sequence
  Description of Artificial Sequence: Synthetic peptide
  XENP023769 vhCDR2
WINTYTGEPTYADGFTG

SEQ ID NO: 778 - protein, 8 aa, Artificial Sequence
  Description of Artificial Sequence: Synthetic peptide
  XENP023769 vhCDR3
DYYGSSPY

SEQ ID NO: 779 - protein, 16 aa, Artificial Sequence
  Description of Artificial Sequence: Synthetic peptide
  XENP023769 vlCDR1
KSSQSIVHSNGNTYLE

SEQ ID NO: 780 - protein, 7 aa, Artificial Sequence
  Description of Artificial Sequence: Synthetic peptide
  XENP023769 vlCDR2
KVSNRFS

SEQ ID NO: 781 - protein, 9 aa, Artificial Sequence
  Description of Artificial Sequence: Synthetic peptide
  XENP023769 vlCDR3
FQGSHVPNT

SEQ ID NO: 782 - protein, 251 aa, Artificial Sequence
  Description of Artificial Sequence: Synthetic polypeptide
  XENP023770 1C11_H3.25_L3_scFv
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 783 - protein, 117 aa, Artificial Sequence
  Description of Artificial Sequence: Synthetic polypeptide
  VH of XENP023770
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSS

SEQ ID NO: 784 - protein, 114 aa, Artificial Sequence; identical to SEQ ID NO: 649
  Description of Artificial Sequence: Synthetic polypeptide
  VL of XENP023770

SEQ ID NO: 785 - protein, 5 aa, Artificial Sequence
  Description of Artificial Sequence: Synthetic peptide
  XENP023770 vhCDR1
HYGMN

SEQ ID NO: 786 - protein, 17 aa, Artificial Sequence
  Description of Artificial Sequence: Synthetic peptide
  XENP023770 vhCDR2
WINTNTGEPTYADGFTG

SEQ ID NO: 787 - protein, 8 aa, Artificial Sequence
  Description of Artificial Sequence: Synthetic peptide
  XENP023770 vhCDR3
DYYGSSPY

SEQ ID NO: 788 - protein, 16 aa, Artificial Sequence
  Description of Artificial Sequence: Synthetic peptide
  XENP023770 vlCDR1
KSSQSIVHSNGNTYLE

SEQ ID NO: 789 - protein, 7 aa, Artificial Sequence
  Description of Artificial Sequence: Synthetic peptide
  XENP023770 vlCDR2
KVSNRFS

SEQ ID NO: 790 - protein, 9 aa, Artificial Sequence
  Description of Artificial Sequence: Synthetic peptide
  XENP023770 vlCDR3
FQGSHVPNT

SEQ ID NO: 791 - protein, 251 aa, Artificial Sequence
  Description of Artificial Sequence: Synthetic polypeptide
  XENP023771 1C11_H3.26_L3_scFv
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 792 - protein, 117 aa, Artificial Sequence
  Description of Artificial Sequence: Synthetic polypeptide
  VH of XENP023771
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSS

SEQ ID NO: 793 - protein, 114 aa, Artificial Sequence; identical to SEQ ID NO: 649
  Description of Artificial Sequence: Synthetic polypeptide
  VL of XENP023771

SEQ ID NO: 794 - protein, 5 aa, Artificial Sequence
  Description of Artificial Sequence: Synthetic peptide
  XENP023771 vhCDR1
HYGMN

SEQ ID NO: 795 - protein, 17 aa, Artificial Sequence
  Description of Artificial Sequence: Synthetic peptide
  XENP023771 vhCDR2
WINTYTGHPTYADGFTG

SEQ ID NO: 796 - protein, 8 aa, Artificial Sequence
  Description of Artificial Sequence: Synthetic peptide
  XENP023771 vhCDR3
DYYGSSPY

SEQ ID NO: 797 - protein, 16 aa, Artificial Sequence
  Description of Artificial Sequence: Synthetic peptide
  XENP023771 vlCDR1
KSSQSIVHSNGNTYLE

SEQ ID NO: 798 - protein, 7 aa, Artificial Sequence
  Description of Artificial Sequence: Synthetic peptide
  XENP023771 vlCDR2
KVSNRFS

SEQ ID NO: 799 - protein, 9 aa, Artificial Sequence
  Description of Artificial Sequence: Synthetic peptide
  XENP023771 vlCDR3
FQGSHVPNT

SEQ ID NO: 800 - protein, 251 aa, Artificial Sequence
  Description of Artificial Sequence: Synthetic polypeptide
  XENP023772 1C11_H3.30_L3_scFv
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 801 - protein, 117 aa, Artificial Sequence
  Description of Artificial Sequence: Synthetic polypeptide
  VH of XENP023772
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSS

SEQ ID NO: 802 - protein, 114 aa, Artificial Sequence; identical to SEQ ID NO: 649
  Description of Artificial Sequence: Synthetic polypeptide
  VL of XENP023772

SEQ ID NO: 803 - protein, 5 aa, Artificial Sequence
  Description of Artificial Sequence: Synthetic peptide
  XENP023772 vhCDR1
HYGMN

SEQ ID NO: 804 - protein, 17 aa, Artificial Sequence
  Description of Artificial Sequence: Synthetic peptide
  XENP023772 vhCDR2
WINTYTGEPEYADGFTG

SEQ ID NO: 805 - protein, 8 aa, Artificial Sequence
  Description of Artificial Sequence: Synthetic peptide
  XENP023772 vhCDR3
DYYGSSPY

SEQ ID NO: 806 - protein, 16 aa, Artificial Sequence
  Description of Artificial Sequence: Synthetic peptide
  XENP023772 vlCDR1
KSSQSIVHSNGNTYLE

SEQ ID NO: 807 - protein, 7 aa, Artificial Sequence
  Description of Artificial Sequence: Synthetic peptide
  XENP023772 vlCDR2
KVSNRFS

SEQ ID NO: 808 - protein, 9 aa, Artificial Sequence
  Description of Artificial Sequence: Synthetic peptide
  XENP023772 vlCDR3
FQGSHVPNT

SEQ ID NO: 809 - protein, 251 aa, Artificial Sequence
  Description of Artificial Sequence: Synthetic polypeptide
  XENP023773 1C11_H3.32_L3_scFv
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 810 - protein, 117 aa, Artificial Sequence
  Description of Artificial Sequence: Synthetic polypeptide
  VH of XENP023773
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSS

SEQ ID NO: 811 - protein, 114 aa, Artificial Sequence; identical to SEQ ID NO: 649
  Description of Artificial Sequence: Synthetic polypeptide
  VL of XENP023773

SEQ ID NO: 812 - protein, 5 aa, Artificial Sequence
  Description of Artificial Sequence: Synthetic peptide
  XENP023773 vhCDR1
HYGMN

SEQ ID NO: 813 - protein, 17 aa, Artificial Sequence
  Description of Artificial Sequence: Synthetic peptide
  XENP023773 vhCDR2
WINTYTGEPTYNDGFTG

SEQ ID NO: 814 - protein, 8 aa, Artificial Sequence
  Description of Artificial Sequence: Synthetic peptide
  XENP023773 vhCDR3
DYYGSSPY

SEQ ID NO: 815 - protein, 16 aa, Artificial Sequence
  Description of Artificial Sequence: Synthetic peptide
  XENP023773 vlCDR1
KSSQSIVHSNGNTYLE

SEQ ID NO: 816 - protein, 7 aa, Artificial Sequence
  Description of Artificial Sequence: Synthetic peptide
  XENP023773 vlCDR2
KVSNRFS

SEQ ID NO: 817 - protein, 9 aa, Artificial Sequence
  Description of Artificial Sequence: Synthetic peptide
  XENP023773 vlCDR3
FQGSHVPNT

SEQ ID NO: 818 - protein, 251 aa, Artificial Sequence
  Description of Artificial Sequence: Synthetic polypeptide
  XENP023774 1C11_H3.33_L3_scFv
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 819 - protein, 117 aa, Artificial Sequence
  Description of Artificial Sequence: Synthetic polypeptide
  VH of XENP023774
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSS

SEQ ID NO: 820 - protein, 114 aa, Artificial Sequence; identical to SEQ ID NO: 649
  Description of Artificial Sequence: Synthetic polypeptide
  VL of XENP023774

SEQ ID NO: 821 - protein, 5 aa, Artificial Sequence
  Description of Artificial Sequence: Synthetic peptide
  XENP023774 vhCDR1
HYGMN

SEQ ID NO: 822 - protein, 17 aa, Artificial Sequence
  Description of Artificial Sequence: Synthetic peptide
  XENP023774 vhCDR2
WINTYTGEPTYAQGFTG

SEQ ID NO: 823 - protein, 8 aa, Artificial Sequence
  Description of Artificial Sequence: Synthetic peptide
  XENP023774 vhCDR3
DYYGSSPY

SEQ ID NO: 824 - protein, 16 aa, Artificial Sequence
  Description of Artificial Sequence: Synthetic peptide
  XENP023774 vlCDR1
KSSQSIVHSNGNTYLE

SEQ ID NO: 825 - protein, 7 aa, Artificial Sequence
  Description of Artificial Sequence: Synthetic peptide
  XENP023774 vlCDR2
KVSNRFS

SEQ ID NO: 826 - protein, 9 aa, Artificial Sequence
  Description of Artificial Sequence: Synthetic peptide
  XENP023774 vlCDR3
FQGSHVPNT

SEQ ID NO: 827 - protein, 251 aa, Artificial Sequence
  Description of Artificial Sequence: Synthetic polypeptide
  XENP023775 1C11_H3.34_L3_scFv
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 828 - protein, 117 aa, Artificial Sequence
  Description of Artificial Sequence: Synthetic polypeptide
  VH of XENP023775
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSS

SEQ ID NO: 829 - protein, 114 aa, Artificial Sequence; identical to SEQ ID NO: 649
  Description of Artificial Sequence: Synthetic polypeptide
  VL of XENP023775

SEQ ID NO: 830 - protein, 5 aa, Artificial Sequence
  Description of Artificial Sequence: Synthetic peptide
  XENP023775 vhCDR1
HYGMN

SEQ ID NO: 831 - protein, 17 aa, Artificial Sequence
  Description of Artificial Sequence: Synthetic peptide
  XENP023775 vhCDR2
WINTYTGEPTYAEGFTG

SEQ ID NO: 832 - protein, 8 aa, Artificial Sequence
  Description of Artificial Sequence: Synthetic peptide
  XENP023775 vhCDR3
DYYGSSPY

SEQ ID NO: 833 - protein, 16 aa, Artificial Sequence
  Description of Artificial Sequence: Synthetic peptide
  XENP023775 vlCDR1
KSSQSIVHSNGNTYLE

SEQ ID NO: 834 - protein, 7 aa, Artificial Sequence
  Description of Artificial Sequence: Synthetic peptide
  XENP023775 vlCDR2
KVSNRFS

SEQ ID NO: 835 - protein, 9 aa, Artificial Sequence
  Description of Artificial Sequence: Synthetic peptide
  XENP023775 vlCDR3
FQGSHVPNT

SEQ ID NO: 836 - protein, 251 aa, Artificial Sequence
  Description of Artificial Sequence: Synthetic polypeptide
  XENP023776 1C11_H3.35_L3_scFv
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 837 - protein, 117 aa, Artificial Sequence
  Description of Artificial Sequence: Synthetic polypeptide
  VH of XENP023776
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSS

SEQ ID NO: 838 - protein, 114 aa, Artificial Sequence; identical to SEQ ID NO: 649
  Description of Artificial Sequence: Synthetic polypeptide
  VL of XENP023776

SEQ ID NO: 839 - protein, 5 aa, Artificial Sequence
  Description of Artificial Sequence: Synthetic peptide
  XENP023776 vhCDR1
HYGMN

SEQ ID NO: 840 - protein, 17 aa, Artificial Sequence
  Description of Artificial Sequence: Synthetic peptide
  XENP023776 vhCDR2
WINTYTGEPTYADKFTG

SEQ ID NO: 841 - protein, 8 aa, Artificial Sequence
  Description of Artificial Sequence: Synthetic peptide
  XENP023776 vhCDR3
DYYGSSPY

SEQ ID NO: 842 - protein, 16 aa, Artificial Sequence
  Description of Artificial Sequence: Synthetic peptide
  XENP023776 vlCDR1
KSSQSIVHSNGNTYLE

SEQ ID NO: 843 - protein, 7 aa, Artificial Sequence
  Description of Artificial Sequence: Synthetic peptide
  XENP023776 vlCDR2
KVSNRFS

SEQ ID NO: 844 - protein, 9 aa, Artificial Sequence
  Description of Artificial Sequence: Synthetic peptide
  XENP023776 vlCDR3
FQGSHVPNT

SEQ ID NO: 845 - protein, 251 aa, Artificial Sequence
  Description of Artificial Sequence: Synthetic polypeptide
  XENP023777 1C11_H3.38_L3_scFv
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 846 - protein, 117 aa, Artificial Sequence
  Description of Artificial Sequence: Synthetic polypeptide
  VH of XENP023777
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSS

SEQ ID NO: 847 - protein, 114 aa, Artificial Sequence; identical to SEQ ID NO: 649
  Description of Artificial Sequence: Synthetic polypeptide
  VL of XENP023777

SEQ ID NO: 848 - protein, 5 aa, Artificial Sequence
  Description of Artificial Sequence: Synthetic peptide
  XENP023777 vhCDR1
HYGMN

SEQ ID NO: 849 - protein, 17 aa, Artificial Sequence
  Description of Artificial Sequence: Synthetic peptide
  XENP023777 vhCDR2
WINTYTGEPTYADGITG

SEQ ID NO: 850 - protein, 8 aa, Artificial Sequence
  Description of Artificial Sequence: Synthetic peptide
  XENP023777 vhCDR3
DYYGSSPY

SEQ ID NO: 851 - protein, 16 aa, Artificial Sequence
  Description of Artificial Sequence: Synthetic peptide
  XENP023777 vlCDR1
KSSQSIVHSNGNTYLE

SEQ ID NO: 852 - protein, 7 aa, Artificial Sequence
  Description of Artificial Sequence: Synthetic peptide
  XENP023777 vlCDR2
KVSNRFS

SEQ ID NO: 853 - protein, 9 aa, Artificial Sequence
  Description of Artificial Sequence: Synthetic peptide
  XENP023777 vlCDR3
FQGSHVPNT

SEQ ID NO: 854 - protein, 251 aa, Artificial Sequence
  Description of Artificial Sequence: Synthetic polypeptide
  XENP023778 1C11_H3.39_L3_scFv
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 855 - protein, 117 aa, Artificial Sequence
  Description of Artificial Sequence: Synthetic polypeptide
  VH of XENP023778
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSS

SEQ ID NO: 856 - protein, 114 aa, Artificial Sequence; identical to SEQ ID NO: 649
  Description of Artificial Sequence: Synthetic polypeptide
  VL of XENP023778

SEQ ID NO: 857 - protein, 5 aa, Artificial Sequence
  Description of Artificial Sequence: Synthetic peptide
  XENP023778 vhCDR1
HYGMN

SEQ ID NO: 858 - protein, 17 aa, Artificial Sequence
  Description of Artificial Sequence: Synthetic peptide
  XENP023778 vhCDR2
WINTYTGEPTYADGLTG

SEQ ID NO: 859 - protein, 8 aa, Artificial Sequence
  Description of Artificial Sequence: Synthetic peptide
  XENP023778 vhCDR3
DYYGSSPY

SEQ ID NO: 860 - protein, 16 aa, Artificial Sequence
  Description of Artificial Sequence: Synthetic peptide
  XENP023778 vlCDR1
KSSQSIVHSNGNTYLE

SEQ ID NO: 861 - protein, 7 aa, Artificial Sequence
  Description of Artificial Sequence: Synthetic peptide
  XENP023778 vlCDR2
KVSNRFS

SEQ ID NO: 862 - protein, 9 aa, Artificial Sequence
  Description of Artificial Sequence: Synthetic peptide
  XENP023778 vlCDR3
FQGSHVPNT

SEQ ID NO: 863 - protein, 251 aa, Artificial Sequence
  Description of Artificial Sequence: Synthetic polypeptide
  XENP023779 1C11_H3.41_L3_scFv
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 864 - protein, 117 aa, Artificial Sequence
  Description of Artificial Sequence: Synthetic polypeptide
  VH of XENP023779
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSS

SEQ ID NO: 865 - protein, 114 aa, Artificial Sequence; identical to SEQ ID NO: 649
  Description of Artificial Sequence: Synthetic polypeptide
  VL of XENP023779

SEQ ID NO: 866 - protein, 5 aa, Artificial Sequence
  Description of Artificial Sequence: Synthetic peptide
  XENP023779 vhCDR1
HYGMN

SEQ ID NO: 867 - protein, 17 aa, Artificial Sequence
  Description of Artificial Sequence: Synthetic peptide
  XENP023779 vhCDR2
WINTYTGEPTYADGFKG

SEQ ID NO: 868 - protein, 8 aa, Artificial Sequence
  Description of Artificial Sequence: Synthetic peptide
  XENP023779 vhCDR3
DYYGSSPY

SEQ ID NO: 869 - protein, 16 aa, Artificial Sequence
  Description of Artificial Sequence: Synthetic peptide
  XENP023779 vlCDR1
KSSQSIVHSNGNTYLE

SEQ ID NO: 870 - protein, 7 aa, Artificial Sequence
  Description of Artificial Sequence: Synthetic peptide
  XENP023779 vlCDR2
KVSNRFS

SEQ ID NO: 871 - protein, 9 aa, Artificial Sequence
  Description of Artificial Sequence: Synthetic peptide
  XENP023779 vlCDR3
FQGSHVPNT

SEQ ID NO: 872 - protein, 251 aa, Artificial Sequence
  Description of Artificial Sequence: Synthetic polypeptide
  XENP023780 1C11_H3.42_L3_scFv
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 873 - protein, 117 aa, Artificial Sequence
  Description of Artificial Sequence: Synthetic polypeptide
  VH of XENP023780
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSS

SEQ ID NO: 874 - protein, 114 aa, Artificial Sequence; identical to SEQ ID NO: 649
  Description of Artificial Sequence: Synthetic polypeptide
  VL of XENP023780

SEQ ID NO: 875 - protein, 5 aa, Artificial Sequence
  Description of Artificial Sequence: Synthetic peptide
  XENP023780 vhCDR1
HYGMN

SEQ ID NO: 876 - protein, 17 aa, Artificial Sequence
  Description of Artificial Sequence: Synthetic peptide
  XENP023780 vhCDR2
WINTYTGEPTYADGFQG

SEQ ID NO: 877 - protein, 8 aa, Artificial Sequence
  Description of Artificial Sequence: Synthetic peptide
  XENP023780 vhCDR3
DYYGSSPY

SEQ ID NO: 878 - protein, 16 aa, Artificial Sequence
  Description of Artificial Sequence: Synthetic peptide
  XENP023780 vlCDR1
KSSQSIVHSNGNTYLE

SEQ ID NO: 879 - protein, 7 aa, Artificial Sequence
  Description of Artificial Sequence: Synthetic peptide
  XENP023780 vlCDR2
KVSNRFS

SEQ ID NO: 880 - protein, 9 aa, Artificial Sequence
  Description of Artificial Sequence: Synthetic peptide
  XENP023780 vlCDR3
FQGSHVPNT

SEQ ID NO: 881 - protein, 251 aa, Artificial Sequence
  Description of Artificial Sequence: Synthetic polypeptide
  XENP023781 1C11_H3.43_L3_scFv
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 882 - protein, 117 aa, Artificial Sequence
  Description of Artificial Sequence: Synthetic polypeptide
  VH of XENP023781
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSS

SEQ ID NO: 883 - protein, 114 aa, Artificial Sequence; identical to SEQ ID NO: 649
  Description of Artificial Sequence: Synthetic polypeptide
  VL of XENP023781

SEQ ID NO: 884 - protein, 5 aa, Artificial Sequence
  Description of Artificial Sequence: Synthetic peptide
  XENP023781 vhCDR1
HYGMN

SEQ ID NO: 885 - protein, 17 aa, Artificial Sequence
  Description of Artificial Sequence: Synthetic peptide
  XENP023781 vhCDR2
WINTYTGEPTYADGFTG

SEQ ID NO: 886 - protein, 8 aa, Artificial Sequence
  Description of Artificial Sequence: Synthetic peptide
  XENP023781 vhCDR3
DYYGSSPY

SEQ ID NO: 887 - protein, 16 aa, Artificial Sequence
  Description of Artificial Sequence: Synthetic peptide
  XENP023781 vlCDR1
KSSQSIVHSNGNTYLE

SEQ ID NO: 888 - protein, 7 aa, Artificial Sequence
  Description of Artificial Sequence: Synthetic peptide
  XENP023781 vlCDR2
KVSNRFS

SEQ ID NO: 889 - protein, 9 aa, Artificial Sequence
  Description of Artificial Sequence: Synthetic peptide
  XENP023781 vlCDR3
FQGSHVPNT

SEQ ID NO: 890 - protein, 251 aa, Artificial Sequence
  Description of Artificial Sequence: Synthetic polypeptide
  XENP023782 1C11_H3.44_L3_scFv
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 891 - protein, 117 aa, Artificial Sequence
  Description of Artificial Sequence: Synthetic polypeptide
  VH of XENP023782
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSS

SEQ ID NO: 892 - protein, 114 aa, Artificial Sequence; identical to SEQ ID NO: 649
  Description of Artificial Sequence: Synthetic polypeptide
  VL of XENP023782

SEQ ID NO: 893 - protein, 5 aa, Artificial Sequence
  Description of Artificial Sequence: Synthetic peptide
  XENP023782 vhCDR1
HYGMN

SEQ ID NO: 894 - protein, 17 aa, Artificial Sequence
  Description of Artificial Sequence: Synthetic peptide
  XENP023782 vhCDR2
WINTYTGEPTYADGFTG

SEQ ID NO: 895 - protein, 8 aa, Artificial Sequence
  Description of Artificial Sequence: Synthetic peptide
  XENP023782 vhCDR3
DYYGSSPY

SEQ ID NO: 896 - protein, 16 aa, Artificial Sequence
  Description of Artificial Sequence: Synthetic peptide
  XENP023782 vlCDR1
KSSQSIVHSNGNTYLE

SEQ ID NO: 897 - protein, 7 aa, Artificial Sequence
  Description of Artificial Sequence: Synthetic peptide
  XENP023782 vlCDR2
KVSNRFS

SEQ ID NO: 898 - protein, 9 aa, Artificial Sequence
  Description of Artificial Sequence: Synthetic peptide
  XENP023782 vlCDR3
FQGSHVPNT

SEQ ID NO: 899 - protein, 251 aa, Artificial Sequence
  Description of Artificial Sequence: Synthetic polypeptide
  XENP023783 1C11_H3.45_L3_scFv
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 900 - protein, 117 aa, Artificial Sequence
  Description of Artificial Sequence: Synthetic polypeptide
  VH of XENP023783
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSS

SEQ ID NO: 901 - protein, 114 aa, Artificial Sequence; identical to SEQ ID NO: 649
  Description of Artificial Sequence: Synthetic polypeptide
  VL of XENP023783

SEQ ID NO: 902 - protein, 5 aa, Artificial Sequence
  Description of Artificial Sequence: Synthetic peptide
  XENP023783 vhCDR1
HYGMN

SEQ ID NO: 903 - protein, 17 aa, Artificial Sequence
  Description of Artificial Sequence: Synthetic peptide
  XENP023783 vhCDR2
WINTYTGEPTYADGFTG

SEQ ID NO: 904 - protein, 8 aa, Artificial Sequence
  Description of Artificial Sequence: Synthetic peptide
  XENP023783 vhCDR3
DYYGSSPY

SEQ ID NO: 905 - protein, 16 aa, Artificial Sequence
  Description of Artificial Sequence: Synthetic peptide
  XENP023783 vlCDR1
KSSQSIVHSNGNTYLE

SEQ ID NO: 906 - protein, 7 aa, Artificial Sequence
  Description of Artificial Sequence: Synthetic peptide
  XENP023783 vlCDR2
KVSNRFS

SEQ ID NO: 907 - protein, 9 aa, Artificial Sequence
  Description of Artificial Sequence: Synthetic peptide
  XENP023783 vlCDR3
FQGSHVPNT

SEQ ID NO: 908 - protein, 251 aa, Artificial Sequence
  Description of Artificial Sequence: Synthetic polypeptide
  XENP023784 1C11_H3.46_L3_scFv
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 909 - protein, 117 aa, Artificial Sequence
  Description of Artificial Sequence: Synthetic polypeptide
  VH of XENP023784
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSS

SEQ ID NO: 910 - protein, 114 aa, Artificial Sequence; identical to SEQ ID NO: 649
  Description of Artificial Sequence: Synthetic polypeptide
  VL of XENP023784

SEQ ID NO: 911 - protein, 5 aa, Artificial Sequence
  Description of Artificial Sequence: Synthetic peptide
  XENP023784 vhCDR1
HYGMN

SEQ ID NO: 912 - protein, 17 aa, Artificial Sequence
  Description of Artificial Sequence: Synthetic peptide
  XENP023784 vhCDR2
WINTYTGEPTYADGFTG

SEQ ID NO: 913 - protein, 8 aa, Artificial Sequence
  Description of Artificial Sequence: Synthetic peptide
  XENP023784 vhCDR3
DYYGSSPY

SEQ ID NO: 914 - protein, 16 aa, Artificial Sequence
  Description of Artificial Sequence: Synthetic peptide
  XENP023784 vlCDR1
KSSQSIVHSNGNTYLE

SEQ ID NO: 915 - protein, 7 aa, Artificial Sequence
  Description of Artificial Sequence: Synthetic peptide
  XENP023784 vlCDR2
KVSNRFS

SEQ ID NO: 916 - protein, 9 aa, Artificial Sequence
  Description of Artificial Sequence: Synthetic peptide
  XENP023784 vlCDR3
FQGSHVPNT

SEQ ID NO: 917 - protein, 251 aa, Artificial Sequence
  Description of Artificial Sequence: Synthetic polypeptide
  XENP023785 1C11_H3.49_L3_scFv
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 918 - protein, 117 aa, Artificial Sequence
  Description of Artificial Sequence: Synthetic polypeptide
  VH of XENP023785
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSS

SEQ ID NO: 919 - protein, 114 aa, Artificial Sequence; identical to SEQ ID NO: 649
  Description of Artificial Sequence: Synthetic polypeptide
  VL of XENP023785

SEQ ID NO: 920 - protein, 5 aa, Artificial Sequence
  Description of Artificial Sequence: Synthetic peptide
  XENP023785 vhCDR1
HYGMN

SEQ ID NO: 921 - protein, 17 aa, Artificial Sequence
  Description of Artificial Sequence: Synthetic peptide
  XENP023785 vhCDR2
WINTYTGEPTYADGFTG

SEQ ID NO: 922 - protein, 8 aa, Artificial Sequence
  Description of Artificial Sequence: Synthetic peptide
  XENP023785 vhCDR3
DYYGSSPY

SEQ ID NO: 923 - protein, 16 aa, Artificial Sequence
  Description of Artificial Sequence: Synthetic peptide
  XENP023785 vlCDR1
KSSQSIVHSNGNTYLE

SEQ ID NO: 924 - protein, 7 aa, Artificial Sequence
  Description of Artificial Sequence: Synthetic peptide
  XENP023785 vlCDR2
KVSNRFS

SEQ ID NO: 925 - protein, 9 aa, Artificial Sequence
  Description of Artificial Sequence: Synthetic peptide
  XENP023785 vlCDR3
FQGSHVPNT

SEQ ID NO: 926 - protein, 251 aa, Artificial Sequence
  Description of Artificial Sequence: Synthetic polypeptide
  XENP023786 1C11_H3.50_L3_scFv
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 927 - protein, 117 aa, Artificial Sequence
  Description of Artificial Sequence: Synthetic polypeptide
  VH of XENP023786
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSS

SEQ ID NO: 928 - protein, 114 aa, Artificial Sequence; identical to SEQ ID NO: 649
  Description of Artificial Sequence: Synthetic polypeptide
  VL of XENP023786

SEQ ID NO: 929 - protein, 5 aa, Artificial Sequence
  Description of Artificial Sequence: Synthetic peptide
  XENP023786 vhCDR1
HYGMN

SEQ ID NO: 930 - protein, 17 aa, Artificial Sequence
  Description of Artificial Sequence: Synthetic peptide
  XENP023786 vhCDR2
WINTYTGEPTYADGFTG

SEQ ID NO: 931 - protein, 8 aa, Artificial Sequence
  Description of Artificial Sequence: Synthetic peptide
  XENP023786 vhCDR3
DYYGSSPY

SEQ ID NO: 932 - protein, 16 aa, Artificial Sequence
  Description of Artificial Sequence: Synthetic peptide
  XENP023786 vlCDR1
KSSQSIVHSNGNTYLE

SEQ ID NO: 933 - protein, 7 aa, Artificial Sequence
  Description of Artificial Sequence: Synthetic peptide
  XENP023786 vlCDR2
KVSNRFS

SEQ ID NO: 934 - protein, 9 aa, Artificial Sequence
  Description of Artificial Sequence: Synthetic peptide
  XENP023786 vlCDR3
FQGSHVPNT

SEQ ID NO: 935 - protein, 251 aa, Artificial Sequence
  Description of Artificial Sequence: Synthetic polypeptide
  XENP023787 1C11_H3.51_L3_scFv
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 936 - protein, 117 aa, Artificial Sequence
  Description of Artificial Sequence: Synthetic polypeptide
  VH of XENP023787
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSS

SEQ ID NO: 937 - protein, 114 aa, Artificial Sequence; identical to SEQ ID NO: 649
  Description of Artificial Sequence: Synthetic polypeptide
  VL of XENP023787

SEQ ID NO: 938 - protein, 5 aa, Artificial Sequence
  Description of Artificial Sequence: Synthetic peptide
  XENP023787 vhCDR1
HYGMN

SEQ ID NO: 939 - protein, 17 aa, Artificial Sequence
  Description of Artificial Sequence: Synthetic peptide
  XENP023787 vhCDR2
WINTYTGEPTYADGFTG

SEQ ID NO: 940 - protein, 8 aa, Artificial Sequence
  Description of Artificial Sequence: Synthetic peptide
  XENP023787 vhCDR3
DYYGSSPY

SEQ ID NO: 941 - protein, 16 aa, Artificial Sequence
  Description of Artificial Sequence: Synthetic peptide
  XENP023787 vlCDR1
KSSQSIVHSNGNTYLE

SEQ ID NO: 942 - protein, 7 aa, Artificial Sequence
  Description of Artificial Sequence: Synthetic peptide
  XENP023787 vlCDR2
KVSNRFS

SEQ ID NO: 943 - protein, 9 aa, Artificial Sequence
  Description of Artificial Sequence: Synthetic peptide
  XENP023787 vlCDR3
FQGSHVPNT

SEQ ID NO: 944 - protein, 251 aa, Artificial Sequence
  Description of Artificial Sequence: Synthetic polypeptide
  XENP023788 1C11_H3.54_L3_scFv
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 945 - protein, 117 aa, Artificial Sequence
  Description of Artificial Sequence: Synthetic polypeptide
  VH of XENP023788
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSS

SEQ ID NO: 946 - protein, 114 aa, Artificial Sequence; identical to SEQ ID NO: 649
  Description of Artificial Sequence: Synthetic polypeptide
  VL of XENP023788

SEQ ID NO: 947 - protein, 5 aa, Artificial Sequence
  Description of Artificial Sequence: Synthetic peptide
  XENP023788 vhCDR1
HYGMN

SEQ ID NO: 948 - protein, 17 aa, Artificial Sequence
  Description of Artificial Sequence: Synthetic peptide
  XENP023788 vhCDR2
WINTYTGEPTYADGFTG

SEQ ID NO: 949 - protein, 8 aa, Artificial Sequence
  Description of Artificial Sequence: Synthetic peptide
  XENP023788 vhCDR3
DYYGSSPY

SEQ ID NO: 950 - protein, 16 aa, Artificial Sequence
  Description of Artificial Sequence: Synthetic peptide
  XENP023788 vlCDR1
KSSQSIVHSNGNTYLE

SEQ ID NO: 951 - protein, 7 aa, Artificial Sequence
  Description of Artificial Sequence: Synthetic peptide
  XENP023788 vlCDR2
KVSNRFS

SEQ ID NO: 952 - protein, 9 aa, Artificial Sequence
  Description of Artificial Sequence: Synthetic peptide
  XENP023788 vlCDR3
FQGSHVPNT

SEQ ID NO: 953 - protein, 251 aa, Artificial Sequence
  Description of Artificial Sequence: Synthetic polypeptide
  XENP023789 1C11_H3.55_L3_scFv
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 954 - protein, 117 aa, Artificial Sequence
  Description of Artificial Sequence: Synthetic polypeptide
  VH of XENP023789
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSS

SEQ ID NO: 955 - protein, 114 aa, Artificial Sequence; identical to SEQ ID NO: 649
  Description of Artificial Sequence: Synthetic polypeptide
  VL of XENP023789

SEQ ID NO: 956 - protein, 5 aa, Artificial Sequence
  Description of Artificial Sequence: Synthetic peptide
  XENP023789 vhCDR1
HYGMN

SEQ ID NO: 957 - protein, 17 aa, Artificial Sequence
  Description of Artificial Sequence: Synthetic peptide
  XENP023789 vhCDR2
WINTYTGEPTYADGFTG

SEQ ID NO: 958 - protein, 8 aa, Artificial Sequence
  Description of Artificial Sequence: Synthetic peptide
  XENP023789 vhCDR3
DYYGSSPY

SEQ ID NO: 959 - protein, 16 aa, Artificial Sequence
  Description of Artificial Sequence: Synthetic peptide
  XENP023789 vlCDR1
KSSQSIVHSNGNTYLE

SEQ ID NO: 960 - protein, 7 aa, Artificial Sequence
  Description of Artificial Sequence: Synthetic peptide
  XENP023789 vlCDR2
KVSNRFS

SEQ ID NO: 961 - protein, 9 aa, Artificial Sequence
  Description of Artificial Sequence: Synthetic peptide
  XENP023789 vlCDR3
FQGSHVPNT

SEQ ID NO: 962 - protein, 251 aa, Artificial Sequence
  Description of Artificial Sequence: Synthetic polypeptide
  XENP023790 1C11_H3.56_L3_scFv
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 963 - protein, 117 aa, Artificial Sequence
  Description of Artificial Sequence: Synthetic polypeptide
  VH of XENP023790
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSS

SEQ ID NO: 964 - protein, 114 aa, Artificial Sequence; identical to SEQ ID NO: 649
  Description of Artificial Sequence: Synthetic polypeptide
  VL of XENP023790

SEQ ID NO: 965 - protein, 5 aa, Artificial Sequence
  Description of Artificial Sequence: Synthetic peptide
  XENP023790 vhCDR1
HYGMN

SEQ ID NO: 966 - protein, 17 aa, Artificial Sequence
  Description of Artificial Sequence: Synthetic peptide
  XENP023790 vhCDR2
WINTYTGEPTYADGFTG

SEQ ID NO: 967 - protein, 8 aa, Artificial Sequence
  Description of Artificial Sequence: Synthetic peptide
  XENP023790 vhCDR3
DYYGSSPY

SEQ ID NO: 968 - protein, 16 aa, Artificial Sequence
  Description of Artificial Sequence: Synthetic peptide
  XENP023790 vlCDR1
KSSQSIVHSNGNTYLE

SEQ ID NO: 969 - protein, 7 aa, Artificial Sequence
  Description of Artificial Sequence: Synthetic peptide
  XENP023790 vlCDR2
KVSNRFS

SEQ ID NO: 970 - protein, 9 aa, Artificial Sequence
  Description of Artificial Sequence: Synthetic peptide
  XENP023790 vlCDR3
FQGSHVPNT

SEQ ID NO: 971 - protein, 251 aa, Artificial Sequence
  Description of Artificial Sequence: Synthetic polypeptide
  XENP023791 1C11_H3.57_L3_scFv
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 972 - protein, 117 aa, Artificial Sequence
  Description of Artificial Sequence: Synthetic polypeptide
  VH of XENP023791
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSS

SEQ ID NO: 973 - protein, 114 aa, Artificial Sequence; identical to SEQ ID NO: 649
  Description of Artificial Sequence: Synthetic polypeptide
  VL of XENP023791

SEQ ID NO: 974 - protein, 5 aa, Artificial Sequence
  Description of Artificial Sequence: Synthetic peptide
  XENP023791 vhCDR1
HYGMN

SEQ ID NO: 975 - protein, 17 aa, Artificial Sequence
  Description of Artificial Sequence: Synthetic peptide
  XENP023791 vhCDR2
WINTYTGEPTYADGFTG

SEQ ID NO: 976 - protein, 8 aa, Artificial Sequence
  Description of Artificial Sequence: Synthetic peptide
  XENP023791 vhCDR3
DYYGSSPY

SEQ ID NO: 977 - protein, 16 aa, Artificial Sequence
  Description of Artificial Sequence: Synthetic peptide
  XENP023791 vlCDR1
KSSQSIVHSNGNTYLE

SEQ ID NO: 978 - protein, 7 aa, Artificial Sequence
  Description of Artificial Sequence: Synthetic peptide
  XENP023791 vlCDR2
KVSNRFS

SEQ ID NO: 979 - protein, 9 aa, Artificial Sequence
  Description of Artificial Sequence: Synthetic peptide
  XENP023791 vlCDR3
FQGSHVPNT

SEQ ID NO: 980 - protein, 251 aa, Artificial Sequence
  Description of Artificial Sequence: Synthetic polypeptide
  XENP023792 1C11_H3.58_L3_scFv
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 981 - protein, 117 aa, Artificial Sequence
  Description of Artificial Sequence: Synthetic polypeptide
  VH of XENP023792
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSS

SEQ ID NO: 982 - protein, 114 aa, Artificial Sequence; identical to SEQ ID NO: 649
  Description of Artificial Sequence: Synthetic polypeptide
  VL of XENP023792

SEQ ID NO: 983 - protein, 5 aa, Artificial Sequence
  Description of Artificial Sequence: Synthetic peptide
  XENP023792 vhCDR1
HYGMN

SEQ ID NO: 984 - protein, 17 aa, Artificial Sequence
  Description of Artificial Sequence: Synthetic peptide
  XENP023792 vhCDR2
WINTYTGEPTYADGFTG

SEQ ID NO: 985 - protein, 8 aa, Artificial Sequence
  Description of Artificial Sequence: Synthetic peptide
  XENP023792 vhCDR3
DYYGSSPY

SEQ ID NO: 986 - protein, 16 aa, Artificial Sequence
  Description of Artificial Sequence: Synthetic peptide
  XENP023792 vlCDR1
KSSQSIVHSNGNTYLE

SEQ ID NO: 987 - protein, 7 aa, Artificial Sequence
  Description of Artificial Sequence: Synthetic peptide
  XENP023792 vlCDR2
KVSNRFS

SEQ ID NO: 988 - protein, 9 aa, Artificial Sequence
  Description of Artificial Sequence: Synthetic peptide
  XENP023792 vlCDR3
FQGSHVPNT

SEQ ID NO: 989 - protein, 251 aa, Artificial Sequence
  Description of Artificial Sequence: Synthetic polypeptide
  XENP023793 1C11_H3.59_L3_scFv
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 990 - protein, 117 aa, Artificial Sequence
  Description of Artificial Sequence: Synthetic polypeptide
  VH of XENP023793
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSS

SEQ ID NO: 991 - protein, 114 aa, Artificial Sequence; identical to SEQ ID NO: 649
  Description of Artificial Sequence: Synthetic polypeptide
  VL of XENP023793

SEQ ID NO: 992 - protein, 5 aa, Artificial Sequence
  Description of Artificial Sequence: Synthetic peptide
  XENP023793 vhCDR1
HYGMN

SEQ ID NO: 993 - protein, 17 aa, Artificial Sequence
  Description of Artificial Sequence: Synthetic peptide
  XENP023793 vhCDR2
WINTYTGEPTYADGFTG

SEQ ID NO: 994 - protein, 8 aa, Artificial Sequence
  Description of Artificial Sequence: Synthetic peptide
  XENP023793 vhCDR3
DYYGSSPY

SEQ ID NO: 995 - protein, 16 aa, Artificial Sequence
  Description of Artificial Sequence: Synthetic peptide
  XENP023793 vlCDR1
KSSQSIVHSNGNTYLE

SEQ ID NO: 996 - protein, 7 aa, Artificial Sequence
  Description of Artificial Sequence: Synthetic peptide
  XENP023793 vlCDR2
KVSNRFS

SEQ ID NO: 997 - protein, 9 aa, Artificial Sequence
  Description of Artificial Sequence: Synthetic peptide
  XENP023793 vlCDR3
FQGSHVPNT

SEQ ID NO: 998 - protein, 251 aa, Artificial Sequence
  Description of Artificial Sequence: Synthetic polypeptide
  XENP023794 1C11_H3.60_L3_scFv
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 999 - protein, 117 aa, Artificial Sequence
  Description of Artificial Sequence: Synthetic polypeptide
  VH of XENP023794
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSS

SEQ ID NO: 1000 - protein, 114 aa, Artificial Sequence; identical to SEQ ID NO: 649
  Description of Artificial Sequence: Synthetic polypeptide
  VL of XENP023794

SEQ ID NO: 1001 - protein, 5 aa, Artificial Sequence
  Description of Artificial Sequence: Synthetic peptide
  XENP023794 vhCDR1
HYGMN

SEQ ID NO: 1002 - protein, 17 aa, Artificial Sequence
  Description of Artificial Sequence: Synthetic peptide
  XENP023794 vhCDR2
WINTYTGEPTYADGFTG

SEQ ID NO: 1003 - protein, 8 aa, Artificial Sequence
  Description of Artificial Sequence: Synthetic peptide
  XENP023794 vhCDR3
DYYGSSPY

SEQ ID NO: 1004 - protein, 16 aa, Artificial Sequence
  Description of Artificial Sequence: Synthetic peptide
  XENP023794 vlCDR1
KSSQSIVHSNGNTYLE

SEQ ID NO: 1005 - protein, 7 aa, Artificial Sequence
  Description of Artificial Sequence: Synthetic peptide
  XENP023794 vlCDR2
KVSNRFS

SEQ ID NO: 1006 - protein, 9 aa, Artificial Sequence
  Description of Artificial Sequence: Synthetic peptide
  XENP023794 vlCDR3
FQGSHVPNT

SEQ ID NO: 1007 - protein, 251 aa, Artificial Sequence
  Description of Artificial Sequence: Synthetic polypeptide
  XENP023795 1C11_H3.61_L3_scFv
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1008 - protein, 117 aa, Artificial Sequence
  Description of Artificial Sequence: Synthetic polypeptide
  VH of XENP023795
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSS

SEQ ID NO: 1009 - protein, 114 aa, Artificial Sequence; identical to SEQ ID NO: 649
  Description of Artificial Sequence: Synthetic polypeptide
  VL of XENP023795

SEQ ID NO: 1010 - protein, 5 aa, Artificial Sequence
  Description of Artificial Sequence: Synthetic peptide
  XENP023795 vhCDR1
HYGMN

SEQ ID NO: 1011 - protein, 17 aa, Artificial Sequence
  Description of Artificial Sequence: Synthetic peptide
  XENP023795 vhCDR2
WINTYTGEPTYADGFTG

SEQ ID NO: 1012 - protein, 8 aa, Artificial Sequence
  Description of Artificial Sequence: Synthetic peptide
  XENP023795 vhCDR3
DYYGSSPY

SEQ ID NO: 1013 - protein, 16 aa, Artificial Sequence
  Description of Artificial Sequence: Synthetic peptide
  XENP023795 vlCDR1
KSSQSIVHSNGNTYLE

SEQ ID NO: 1014 - protein, 7 aa, Artificial Sequence
  Description of Artificial Sequence: Synthetic peptide
  XENP023795 vlCDR2
KVSNRFS

SEQ ID NO: 1015 - protein, 9 aa, Artificial Sequence
  Description of Artificial Sequence: Synthetic peptide
  XENP023795 vlCDR3
FQGSHVPNT

SEQ ID NO: 1016 - protein, 251 aa, Artificial Sequence
  Description of Artificial Sequence: Synthetic polypeptide
  XENP023796 1C11_H3.62_L3_scFv
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1017 - protein, 117 aa, Artificial Sequence
  Description of Artificial Sequence: Synthetic polypeptide
  VH of XENP023796
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSS

SEQ ID NO: 1018 - protein, 114 aa, Artificial Sequence; identical to SEQ ID NO: 649
  Description of Artificial Sequence: Synthetic polypeptide
  VL of XENP023796

SEQ ID NO: 1019 - protein, 5 aa, Artificial Sequence
  Description of Artificial Sequence: Synthetic peptide
  XENP023796 vhCDR1
HYGMN

SEQ ID NO: 1020 - protein, 17 aa, Artificial Sequence
  Description of Artificial Sequence: Synthetic peptide
  XENP023796 vhCDR2
WINTYTGEPTYADGFTG

SEQ ID NO: 1021 - protein, 8 aa, Artificial Sequence
  Description of Artificial Sequence: Synthetic peptide
  XENP023796 vhCDR3
DYYGSSPY

SEQ ID NO: 1022 - protein, 16 aa, Artificial Sequence
  Description of Artificial Sequence: Synthetic peptide
  XENP023796 vlCDR1
KSSQSIVHSNGNTYLE

SEQ ID NO: 1023 - protein, 7 aa, Artificial Sequence
  Description of Artificial Sequence: Synthetic peptide
  XENP023796 vlCDR2
KVSNRFS

SEQ ID NO: 1024 - protein, 9 aa, Artificial Sequence
  Description of Artificial Sequence: Synthetic peptide
  XENP023796 vlCDR3
FQGSHVPNT

SEQ ID NO: 1025 - protein, 251 aa, Artificial Sequence
  Description of Artificial Sequence: Synthetic polypeptide
  XENP023801 1C11_H3.64_L3_scFv
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1026 - protein, 117 aa, Artificial Sequence
  Description of Artificial Sequence: Synthetic polypeptide
  VH of XENP023801
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSS

SEQ ID NO: 1027 - protein, 114 aa, Artificial Sequence; identical to SEQ ID NO: 649
  Description of Artificial Sequence: Synthetic polypeptide
  VL of XENP023801

SEQ ID NO: 1028 - protein, 5 aa, Artificial Sequence
  Description of Artificial Sequence: Synthetic peptide
  XENP023801 vhCDR1
HYGMN

SEQ ID NO: 1029 - protein, 17 aa, Artificial Sequence
  Description of Artificial Sequence: Synthetic peptide
  XENP023801 vhCDR2
WINTYTGEPTYADGFTG

SEQ ID NO: 1030 - protein, 8 aa, Artificial Sequence
  Description of Artificial Sequence: Synthetic peptide
  XENP023801 vhCDR3
DYYGSSPY

SEQ ID NO: 1031 - protein, 16 aa, Artificial Sequence
  Description of Artificial Sequence: Synthetic peptide
  XENP023801 vlCDR1
KSSQSIVHSNGNTYLE

SEQ ID NO: 1032 - protein, 7 aa, Artificial Sequence
  Description of Artificial Sequence: Synthetic peptide
  XENP023801 vlCDR2
KVSNRFS

SEQ ID NO: 1033 - protein, 9 aa, Artificial Sequence
  Description of Artificial Sequence: Synthetic peptide
  XENP023801 vlCDR3
FQGSHVPNT

SEQ ID NO: 1034 - protein, 251 aa, Artificial Sequence
  Description of Artificial Sequence: Synthetic polypeptide
  XENP023802 1C11_H3.65_L3_scFv
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1035 - protein, 117 aa, Artificial Sequence
  Description of Artificial Sequence: Synthetic polypeptide
  VH of XENP023802
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSS

SEQ ID NO: 1036 - protein, 114 aa, Artificial Sequence; identical to SEQ ID NO: 649
  Description of Artificial Sequence: Synthetic polypeptide
  VL of XENP023802

SEQ ID NO: 1037 - protein, 5 aa, Artificial Sequence
  Description of Artificial Sequence: Synthetic peptide
  XENP023802 vhCDR1
HYGMN

SEQ ID NO: 1038 - protein, 17 aa, Artificial Sequence
  Description of Artificial Sequence: Synthetic peptide
  XENP023802 vhCDR2
WINTYTGEPTYADGFTG

SEQ ID NO: 1039 - protein, 8 aa, Artificial Sequence
  Description of Artificial Sequence: Synthetic peptide
  XENP023802 vhCDR3
DYYGSSPY

SEQ ID NO: 1040 - protein, 16 aa, Artificial Sequence
  Description of Artificial Sequence: Synthetic peptide
  XENP023802 vlCDR1
KSSQSIVHSNGNTYLE

SEQ ID NO: 1041 - protein, 7 aa, Artificial Sequence
  Description of Artificial Sequence: Synthetic peptide
  XENP023802 vlCDR2
KVSNRFS

SEQ ID NO: 1042 - protein, 9 aa, Artificial Sequence
  Description of Artificial Sequence: Synthetic peptide
  XENP023802 vlCDR3
FQGSHVPNT

SEQ ID NO: 1043 - protein, 251 aa, Artificial Sequence
  Description of Artificial Sequence: Synthetic polypeptide
  XENP023803 1C11_H3.66_L3_scFv
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1044 - protein, 117 aa, Artificial Sequence
  Description of Artificial Sequence: Synthetic polypeptide
  VH of XENP023803
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSS

SEQ ID NO: 1045 - protein, 114 aa, Artificial Sequence; identical to SEQ ID NO: 649
  Description of Artificial Sequence: Synthetic polypeptide
  VL of XENP023803

SEQ ID NO: 1046 - protein, 5 aa, Artificial Sequence
  Description of Artificial Sequence: Synthetic peptide
  XENP023803 vhCDR1
HYGMN

SEQ ID NO: 1047 - protein, 17 aa, Artificial Sequence
  Description of Artificial Sequence: Synthetic peptide
  XENP023803 vhCDR2
WINTYTGEPTYADGFTG

SEQ ID NO: 1048 - protein, 8 aa, Artificial Sequence
  Description of Artificial Sequence: Synthetic peptide
  XENP023803 vhCDR3
DYYGSSPY

SEQ ID NO: 1049 - protein, 16 aa, Artificial Sequence
  Description of Artificial Sequence: Synthetic peptide
  XENP023803 vlCDR1
KSSQSIVHSNGNTYLE

SEQ ID NO: 1050 - protein, 7 aa, Artificial Sequence
  Description of Artificial Sequence: Synthetic peptide
  XENP023803 vlCDR2
KVSNRFS

SEQ ID NO: 1051 - protein, 9 aa, Artificial Sequence
  Description of Artificial Sequence: Synthetic peptide
  XENP023803 vlCDR3
FQGSHVPNT

SEQ ID NO: 1052 - protein, 251 aa, Artificial Sequence
  Description of Artificial Sequence: Synthetic polypeptide
  XENP023804 1C11_H3.67_L3_scFv
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1053 - protein, 117 aa, Artificial Sequence
  Description of Artificial Sequence: Synthetic polypeptide
  VH of XENP023804
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSS

SEQ ID NO: 1054 - protein, 114 aa, Artificial Sequence; identical to SEQ ID NO: 649
  Description of Artificial Sequence: Synthetic polypeptide
  VL of XENP023804

SEQ ID NO: 1055 - protein, 5 aa, Artificial Sequence
  Description of Artificial Sequence: Synthetic peptide
  XENP023804 vhCDR1
HYGMN

SEQ ID NO: 1056 - protein, 17 aa, Artificial Sequence
  Description of Artificial Sequence: Synthetic peptide
  XENP023804 vhCDR2
WINTYTGEPTYADGFTG

SEQ ID NO: 1057 - protein, 8 aa, Artificial Sequence
  Description of Artificial Sequence: Synthetic peptide
  XENP023804 vhCDR3
DYYGSSPY

SEQ ID NO: 1058 - protein, 16 aa, Artificial Sequence
  Description of Artificial Sequence: Synthetic peptide
  XENP023804 vlCDR1
KSSQSIVHSNGNTYLE

SEQ ID NO: 1059 - protein, 7 aa, Artificial Sequence
  Description of Artificial Sequence: Synthetic peptide
  XENP023804 vlCDR2
KVSNRFS

SEQ ID NO: 1060 - protein, 9 aa, Artificial Sequence
  Description of Artificial Sequence: Synthetic peptide
  XENP023804 vlCDR3
FQGSHVPNT

SEQ ID NO: 1061 - protein, 251 aa, Artificial Sequence
  Description of Artificial Sequence: Synthetic polypeptide
  XENP023805 1C11_H3.68_L3_scFv
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1062 - protein, 117 aa, Artificial Sequence
  Description of Artificial Sequence: Synthetic polypeptide
  VH of XENP023805
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSS

SEQ ID NO: 1063 - protein, 114 aa, Artificial Sequence; identical to SEQ ID NO: 649
  Description of Artificial Sequence: Synthetic polypeptide
  VL of XENP023805

SEQ ID NO: 1064 - protein, 5 aa, Artificial Sequence
  Description of Artificial Sequence: Synthetic peptide
  XENP023805 vhCDR1
HYGMN

SEQ ID NO: 1065 - protein, 17 aa, Artificial Sequence
  Description of Artificial Sequence: Synthetic peptide
  XENP023805 vhCDR2
WINTYTGEPTYADGFTG

SEQ ID NO: 1066 - protein, 8 aa, Artificial Sequence
  Description of Artificial Sequence: Synthetic peptide
  XENP023805 vhCDR3
DYYGSSPY

SEQ ID NO: 1067 - protein, 16 aa, Artificial Sequence
  Description of Artificial Sequence: Synthetic peptide
  XENP023805 vlCDR1
KSSQSIVHSNGNTYLE

SEQ ID NO: 1068 - protein, 7 aa, Artificial Sequence
  Description of Artificial Sequence: Synthetic peptide
  XENP023805 vlCDR2
KVSNRFS

SEQ ID NO: 1069 - protein, 9 aa, Artificial Sequence
  Description of Artificial Sequence: Synthetic peptide
  XENP023805 vlCDR3
FQGSHVPNT

SEQ ID NO: 1070 - protein, 251 aa, Artificial Sequence
  Description of Artificial Sequence: Synthetic polypeptide
  XENP023806 1C11_H3.69_L3_scFv
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1071 - protein, 117 aa, Artificial Sequence
  Description of Artificial Sequence: Synthetic polypeptide
  VH of XENP023806
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSS

SEQ ID NO: 1072 - protein, 114 aa, Artificial Sequence; identical to SEQ ID NO: 649
  Description of Artificial Sequence: Synthetic polypeptide
  VL of XENP023806

SEQ ID NO: 1073 - protein, 5 aa, Artificial Sequence
  Description of Artificial Sequence: Synthetic peptide
  XENP023806 vhCDR1
HYGMN

SEQ ID NO: 1074 - protein, 17 aa, Artificial Sequence
  Description of Artificial Sequence: Synthetic peptide
  XENP023806 vhCDR2
WINTYTGEPTYADGFTG

SEQ ID NO: 1075 - protein, 8 aa, Artificial Sequence
  Description of Artificial Sequence: Synthetic peptide
  XENP023806 vhCDR3
DYYGSSPY

SEQ ID NO: 1076 - protein, 16 aa, Artificial Sequence
  Description of Artificial Sequence: Synthetic peptide
  XENP023806 vlCDR1
KSSQSIVHSNGNTYLE

SEQ ID NO: 1077 - protein, 7 aa, Artificial Sequence
  Description of Artificial Sequence: Synthetic peptide
  XENP023806 vlCDR2
KVSNRFS

SEQ ID NO: 1078 - protein, 9 aa, Artificial Sequence
  Description of Artificial Sequence: Synthetic peptide
  XENP023806 vlCDR3
FQGSHVPNT

SEQ ID NO: 1079 - protein, 251 aa, Artificial Sequence
  Description of Artificial Sequence: Synthetic polypeptide
  XENP023807 1C11_H3.70_L3_scFv
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1080 - protein, 117 aa, Artificial Sequence
  Description of Artificial Sequence: Synthetic polypeptide
  VH of XENP023807
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSS

SEQ ID NO: 1081 - protein, 114 aa, Artificial Sequence; identical to SEQ ID NO: 649
  Description of Artificial Sequence: Synthetic polypeptide
  VL of XENP023807

SEQ ID NO: 1082 - protein, 5 aa, Artificial Sequence
  Description of Artificial Sequence: Synthetic peptide
  XENP023807 vhCDR1
HYGMN

SEQ ID NO: 1083 - protein, 17 aa, Artificial Sequence
  Description of Artificial Sequence: Synthetic peptide
  XENP023807 vhCDR2
WINTYTGEPTYADGFTG

SEQ ID NO: 1084 - protein, 8 aa, Artificial Sequence
  Description of Artificial Sequence: Synthetic peptide
  XENP023807 vhCDR3
DYYGSSPY

SEQ ID NO: 1085 - protein, 16 aa, Artificial Sequence
  Description of Artificial Sequence: Synthetic peptide
  XENP023807 vlCDR1
KSSQSIVHSNGNTYLE

SEQ ID NO: 1086 - protein, 7 aa, Artificial Sequence
  Description of Artificial Sequence: Synthetic peptide
  XENP023807 vlCDR2
KVSNRFS

SEQ ID NO: 1087 - protein, 9 aa, Artificial Sequence
  Description of Artificial Sequence: Synthetic peptide
  XENP023807 vlCDR3
FQGSHVPNT

SEQ ID NO: 1088 - protein, 251 aa, Artificial Sequence
  Description of Artificial Sequence: Synthetic polypeptide
  XENP023808 1C11_H3.71_L3_scFv
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1089 - protein, 117 aa, Artificial Sequence
  Description of Artificial Sequence: Synthetic polypeptide
  VH of XENP023808
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSS

SEQ ID NO: 1090 - protein, 114 aa, Artificial Sequence; identical to SEQ ID NO: 649
  Description of Artificial Sequence: Synthetic polypeptide
  VL of XENP023808

SEQ ID NO: 1091 - protein, 5 aa, Artificial Sequence
  Description of Artificial Sequence: Synthetic peptide
  XENP023808 vhCDR1
HYGMN

SEQ ID NO: 1092 - protein, 17 aa, Artificial Sequence
  Description of Artificial Sequence: Synthetic peptide
  XENP023808 vhCDR2
WINTYTGEPTYADGFTG

SEQ ID NO: 1093 - protein, 8 aa, Artificial Sequence
  Description of Artificial Sequence: Synthetic peptide
  XENP023808 vhCDR3
DYYGSSPY

SEQ ID NO: 1094 - protein, 16 aa, Artificial Sequence
  Description of Artificial Sequence: Synthetic peptide
  XENP023808 vlCDR1
KSSQSIVHSNGNTYLE

SEQ ID NO: 1095 - protein, 7 aa, Artificial Sequence
  Description of Artificial Sequence: Synthetic peptide
  XENP023808 vlCDR2
KVSNRFS

SEQ ID NO: 1096 - protein, 9 aa, Artificial Sequence
  Description of Artificial Sequence: Synthetic peptide
  XENP023808 vlCDR3
FQGSHVPNT

SEQ ID NO: 1097 - protein, 251 aa, Artificial Sequence
  Description of Artificial Sequence: Synthetic polypeptide
  XENP023809 1C11_H3.72_L3_scFv
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1098 - protein, 117 aa, Artificial Sequence
  Description of Artificial Sequence: Synthetic polypeptide
  VH of XENP023809
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSS

SEQ ID NO: 1099 - protein, 114 aa, Artificial Sequence; identical to SEQ ID NO: 649
  Description of Artificial Sequence: Synthetic polypeptide
  VL of XENP023809

SEQ ID NO: 1100 - protein, 5 aa, Artificial Sequence
  Description of Artificial Sequence: Synthetic peptide
  XENP023809 vhCDR1
HYGMN

SEQ ID NO: 1101 - protein, 17 aa, Artificial Sequence
  Description of Artificial Sequence: Synthetic peptide
  XENP023809 vhCDR2
WINTYTGEPTYADGFTG

SEQ ID NO: 1102 - protein, 8 aa, Artificial Sequence
  Description of Artificial Sequence: Synthetic peptide
  XENP023809 vhCDR3
DYYGSSPY

SEQ ID NO: 1103 - protein, 16 aa, Artificial Sequence
  Description of Artificial Sequence: Synthetic peptide
  XENP023809 vlCDR1
KSSQSIVHSNGNTYLE

SEQ ID NO: 1104 - protein, 7 aa, Artificial Sequence
  Description of Artificial Sequence: Synthetic peptide
  XENP023809 vlCDR2
KVSNRFS

SEQ ID NO: 1105 - protein, 9 aa, Artificial Sequence
  Description of Artificial Sequence: Synthetic peptide
  XENP023809 vlCDR3
FQGSHVPNT

SEQ ID NO: 1106 - protein, 251 aa, Artificial Sequence
  Description of Artificial Sequence: Synthetic polypeptide
  XENP023810 1C11_H3.73_L3_scFv
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1107 - protein, 117 aa, Artificial Sequence
  Description of Artificial Sequence: Synthetic polypeptide
  VH of XENP023810
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSS

SEQ ID NO: 1108 - protein, 114 aa, Artificial Sequence; identical to SEQ ID NO: 649
  Description of Artificial Sequence: Synthetic polypeptide
  VL of XENP023810

SEQ ID NO: 1109 - protein, 5 aa, Artificial Sequence
  Description of Artificial Sequence: Synthetic peptide
  XENP023810 vhCDR1
HYGMN

SEQ ID NO: 1110 - protein, 17 aa, Artificial Sequence
  Description of Artificial Sequence: Synthetic peptide
  XENP023810 vhCDR2
WINTYTGEPTYADGFTG

SEQ ID NO: 1111 - protein, 8 aa, Artificial Sequence
  Description of Artificial Sequence: Synthetic peptide
  XENP023810 vhCDR3
DYYGSSPY

SEQ ID NO: 1112 - protein, 16 aa, Artificial Sequence
  Description of Artificial Sequence: Synthetic peptide
  XENP023810 vlCDR1
KSSQSIVHSNGNTYLE

SEQ ID NO: 1113 - protein, 7 aa, Artificial Sequence
  Description of Artificial Sequence: Synthetic peptide
  XENP023810 vlCDR2
KVSNRFS

SEQ ID NO: 1114 - protein, 9 aa, Artificial Sequence
  Description of Artificial Sequence: Synthetic peptide
  XENP023810 vlCDR3
FQGSHVPNT

SEQ ID NO: 1115 - protein, 251 aa, Artificial Sequence
  Description of Artificial Sequence: Synthetic polypeptide
  XENP023811 1C11_H3.74_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1116 - protein, 117 aa, Artificial Sequence
  Description of Artificial Sequence: Synthetic polypeptide
  VH of XENP023811
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSS

SEQ ID NO: 1117 - protein, 114 aa, Artificial Sequence; identical to SEQ ID NO: 649
  Description of Artificial Sequence: Synthetic polypeptide
  VL of XENP023811

SEQ ID NO: 1118 - protein, 5 aa, Artificial Sequence
  Description of Artificial Sequence: Synthetic peptide
  XENP023811 vhCDR1
HYGMN

SEQ ID NO: 1119 - protein, 17 aa, Artificial Sequence
  Description of Artificial Sequence: Synthetic peptide
  XENP023811 vhCDR2
WINTYTGEPTYADGFTG

SEQ ID NO: 1120 - protein, 8 aa, Artificial Sequence
  Description of Artificial Sequence: Synthetic peptide
  XENP023811 vhCDR3
DYYGSSPY

SEQ ID NO: 1121 - protein, 16 aa, Artificial Sequence
  Description of Artificial Sequence: Synthetic peptide
  XENP023811 vlCDR1
KSSQSIVHSNGNTYLE

SEQ ID NO: 1122 - protein, 7 aa, Artificial Sequence
  Description of Artificial Sequence: Synthetic peptide
  XENP023811 vlCDR2
KVSNRFS

SEQ ID NO: 1123 - protein, 9 aa, Artificial Sequence
  Description of Artificial Sequence: Synthetic peptide
  XENP023811 vlCDR3
FQGSHVPNT

SEQ ID NO: 1124 - protein, 251 aa, Artificial Sequence
  Description of Artificial Sequence: Synthetic polypeptide
  XENP023812 1C11_H3.75_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1125 - protein, 117 aa, Artificial Sequence
  Description of Artificial Sequence: Synthetic polypeptide
  VH of XENP023812
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSS

SEQ ID NO: 1126 - protein, 114 aa, Artificial Sequence; identical to SEQ ID NO: 649
  Description of Artificial Sequence: Synthetic polypeptide
  VL of XENP023812

SEQ ID NO: 1127 - protein, 5 aa, Artificial Sequence
  Description of Artificial Sequence: Synthetic peptide
  XENP023812 vhCDR1
HYGMN

SEQ ID NO: 1128 - protein, 17 aa, Artificial Sequence
  Description of Artificial Sequence: Synthetic peptide
  XENP023812 vhCDR2
WINTYTGEPTYADGFTG

SEQ ID NO: 1129 - protein, 8 aa, Artificial Sequence
  Description of Artificial Sequence: Synthetic peptide
  XENP023812 vhCDR3
DYYGSSPY

SEQ ID NO: 1130 - protein, 16 aa, Artificial Sequence
  Description of Artificial Sequence: Synthetic peptide
  XENP023812 vlCDR1
KSSQSIVHSNGNTYLE

SEQ ID NO: 1131 - protein, 7 aa, Artificial Sequence
  Description of Artificial Sequence: Synthetic peptide
  XENP023812 vlCDR2
KVSNRFS

SEQ ID NO: 1132 - protein, 9 aa, Artificial Sequence
  Description of Artificial Sequence: Synthetic peptide
  XENP023812 vlCDR3
FQGSHVPNT

SEQ ID NO: 1133 - protein, 251 aa, Artificial Sequence
  Description of Artificial Sequence: Synthetic polypeptide
  XENP024191 1C11_H3_L3.84_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 1134 - protein, 117 aa, Artificial Sequence; identical to SEQ ID NO: 32
  Description of Artificial Sequence: Synthetic polypeptide
  VH of XENP024191

SEQ ID NO: 1135 - protein, 114 aa, Artificial Sequence
  Description of Artificial Sequence: Synthetic polypeptide
  VL of XENP024191
DVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 1136 - protein, 5 aa, Artificial Sequence
  Description of Artificial Sequence: Synthetic peptide
  XENP024191 vhCDR1
HYGMN

SEQ ID NO: 1137 - protein, 17 aa, Artificial Sequence
  Description of Artificial Sequence: Synthetic peptide
  XENP024191 vhCDR2
WINTYTGEPTYADGFTG

SEQ ID NO: 1138 - protein, 8 aa, Artificial Sequence
  Description of Artificial Sequence: Synthetic peptide
  XENP024191 vhCDR3
DYYGSSPY

SEQ ID NO: 1139 - protein, 16 aa, Artificial Sequence
  Description of Artificial Sequence: Synthetic peptide
  XENP024191 vlCDR1
KASQSIVHSNGNTYLE

SEQ ID NO: 1140 - protein, 7 aa, Artificial Sequence
  Description of Artificial Sequence: Synthetic peptide
  XENP024191 vlCDR2
KVSNRFS

SEQ ID NO: 1141 - protein, 9 aa, Artificial Sequence
  Description of Artificial Sequence: Synthetic peptide
  XENP024191 vlCDR3
FQGSHVPNT

SEQ ID NO: 1142 - protein, 251 aa, Artificial Sequence
  Description of Artificial Sequence: Synthetic polypeptide
  XENP024192 1C11_H3_L3.102_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1143 - protein, 117 aa, Artificial Sequence; identical to SEQ ID NO: 32
  Description of Artificial Sequence: Synthetic polypeptide
  VH of XENP024192

SEQ ID NO: 1144 - protein, 114 aa, Artificial Sequence
  Description of Artificial Sequence: Synthetic polypeptide
  VL of XENP024192
DVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1145 - protein, 5 aa, Artificial Sequence
  Description of Artificial Sequence: Synthetic peptide
  XENP024192 vhCDR1
HYGMN

SEQ ID NO: 1146 - protein, 17 aa, Artificial Sequence
  Description of Artificial Sequence: Synthetic peptide
  XENP024192 vhCDR2
WINTYTGEPTYADGFTG

SEQ ID NO: 1147 - protein, 8 aa, Artificial Sequence
  Description of Artificial Sequence: Synthetic peptide
  XENP024192 vhCDR3
DYYGSSPY

SEQ ID NO: 1148 - protein, 16 aa, Artificial Sequence
  Description of Artificial Sequence: Synthetic peptide
  XENP024192 vlCDR1
KSSQSIVHSNGNTYLE

SEQ ID NO: 1149 - protein, 7 aa, Artificial Sequence
  Description of Artificial Sequence: Synthetic peptide
  XENP024192 vlCDR2
KVSNRFS

SEQ ID NO: 1150 - protein, 9 aa, Artificial Sequence
  Description of Artificial Sequence: Synthetic peptide
  XENP024192 vlCDR3
FQGSHVPNT

SEQ ID NO: 1151 - protein, 251 aa, Artificial Sequence
  Description of Artificial Sequence: Synthetic polypeptide
  XENP024193 1C11_H3_L3.103_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1152 - protein, 117 aa, Artificial Sequence; identical to SEQ ID NO: 32
  Description of Artificial Sequence: Synthetic polypeptide
  VH of XENP024193

SEQ ID NO: 1153 - protein, 114 aa, Artificial Sequence
  Description of Artificial Sequence: Synthetic polypeptide
  VL of XENP024193
DVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1154 - protein, 5 aa, Artificial Sequence
  Description of Artificial Sequence: Synthetic peptide
  XENP024193 vhCDR1
HYGMN

SEQ ID NO: 1155 - protein, 17 aa, Artificial Sequence
  Description of Artificial Sequence: Synthetic peptide
  XENP024193 vhCDR2
WINTYTGEPTYADGFTG

SEQ ID NO: 1156 - protein, 8 aa, Artificial Sequence
  Description of Artificial Sequence: Synthetic peptide
  XENP024193 vhCDR3
DYYGSSPY

SEQ ID NO: 1157 - protein, 16 aa, Artificial Sequence
  Description of Artificial Sequence: Synthetic peptide
  XENP024193 vlCDR1
KSSQSIVHSNGNTYLE

SEQ ID NO: 1158 - protein, 7 aa, Artificial Sequence
  Description of Artificial Sequence: Synthetic peptide
  XENP024193 vlCDR2
KVSNRFS

SEQ ID NO: 1159 - protein, 9 aa, Artificial Sequence
  Description of Artificial Sequence: Synthetic peptide
  XENP024193 vlCDR3
FQGSHVPNT

SEQ ID NO: 1160 - protein, 251 aa, Artificial Sequence; identical to SEQ ID NO: 233
  Description of Artificial Sequence: Synthetic polypeptide
  XENP024194 1C11_H3_L3.104_scFv

SEQ ID NO: 1161 - protein, 117 aa, Artificial Sequence; identical to SEQ ID NO: 32
  Description of Artificial Sequence: Synthetic polypeptide
  VH of XENP024194

SEQ ID NO: 1162 - protein, 114 aa, Artificial Sequence; identical to SEQ ID NO: 235
  Description of Artificial Sequence: Synthetic polypeptide
  VL of XENP024194

SEQ ID NO: 1163 - protein, 5 aa, Artificial Sequence
  Description of Artificial Sequence: Synthetic peptide
  XENP024194 vhCDR1
HYGMN

SEQ ID NO: 1164 - protein, 17 aa, Artificial Sequence
  Description of Artificial Sequence: Synthetic peptide
  XENP024194 vhCDR2
WINTYTGEPTYADGFTG

SEQ ID NO: 1165 - protein, 8 aa, Artificial Sequence
  Description of Artificial Sequence: Synthetic peptide
  XENP024194 vhCDR3
DYYGSSPY

SEQ ID NO: 1166 - protein, 16 aa, Artificial Sequence
  Description of Artificial Sequence: Synthetic peptide
  XENP024194 vlCDR1
KSSQSIVHSNGNTYLE

SEQ ID NO: 1167 - protein, 7 aa, Artificial Sequence
  Description of Artificial Sequence: Synthetic peptide
  XENP024194 vlCDR2
KVSNRFS

SEQ ID NO: 1168 - protein, 9 aa, Artificial Sequence
  Description of Artificial Sequence: Synthetic peptide
  XENP024194 vlCDR3
FQGSHVPNT

SEQ ID NO: 1169 - protein, 251 aa, Artificial Sequence
  Description of Artificial Sequence: Synthetic polypeptide
  XENP024195 1C11_H3_L3.111_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1170 - protein, 117 aa, Artificial Sequence; identical to SEQ ID NO: 32
  Description of Artificial Sequence: Synthetic polypeptide
  VH of XENP024195

SEQ ID NO: 1171 - protein, 114 aa, Artificial Sequence
  Description of Artificial Sequence: Synthetic polypeptide
  VL of XENP024195
DVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1172 - protein, 5 aa, Artificial Sequence
  Description of Artificial Sequence: Synthetic peptide
  XENP024195 vhCDR1
HYGMN

SEQ ID NO: 1173 - protein, 17 aa, Artificial Sequence
  Description of Artificial Sequence: Synthetic peptide
  XENP024195 vhCDR2
WINTYTGEPTYADGFTG

SEQ ID NO: 1174 - protein, 8 aa, Artificial Sequence
  Description of Artificial Sequence: Synthetic peptide
  XENP024195 vhCDR3
DYYGSSPY

SEQ ID NO: 1175 - protein, 16 aa, Artificial Sequence
  Description of Artificial Sequence: Synthetic peptide
  XENP024195 vlCDR1
KSSQGIVHSNGNTYLE

SEQ ID NO: 1176 - protein, 7 aa, Artificial Sequence
  Description of Artificial Sequence: Synthetic peptide
  XENP024195 vlCDR2
KVSNRFS

SEQ ID NO: 1177 - protein, 9 aa, Artificial Sequence
  Description of Artificial Sequence: Synthetic peptide
  XENP024195 vlCDR3
FQGSHVPNT

SEQ ID NO: 1178 - protein, 251 aa, Artificial Sequence
  Description of Artificial Sequence: Synthetic polypeptide
  XENP024196 1C11_H3_L3.112_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1179 - protein, 117 aa, Artificial Sequence; identical to SEQ ID NO: 32
  Description of Artificial Sequence: Synthetic polypeptide
  VH of XENP024196

SEQ ID NO: 1180 - protein, 114 aa, Artificial Sequence
  Description of Artificial Sequence: Synthetic polypeptide
  VL of XENP024196
DVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1181 - protein, 5 aa, Artificial Sequence
  Description of Artificial Sequence: Synthetic peptide
  XENP024196 vhCDR1
HYGMN

SEQ ID NO: 1182 - protein, 17 aa, Artificial Sequence
  Description of Artificial Sequence: Synthetic peptide
  XENP024196 vhCDR2
WINTYTGEPTYADGFTG

SEQ ID NO: 1183 - protein, 8 aa, Artificial Sequence
  Description of Artificial Sequence: Synthetic peptide
  XENP024196 vhCDR3
DYYGSSPY

SEQ ID NO: 1184 - protein, 16 aa, Artificial Sequence
  Description of Artificial Sequence: Synthetic peptide
  XENP024196 vlCDR1
KSSQSVLHSNGNTYLE

SEQ ID NO: 1185 - protein, 7 aa, Artificial Sequence
  Description of Artificial Sequence: Synthetic peptide
  XENP024196 vlCDR2
KVSNRFS

SEQ ID NO: 1186 - protein, 9 aa, Artificial Sequence
  Description of Artificial Sequence: Synthetic peptide
  XENP024196 vlCDR3
FQGSHVPNT

SEQ ID NO: 1187 - protein, 251 aa, Artificial Sequence
  Description of Artificial Sequence: Synthetic polypeptide
  XENP024201 1C11_H3_L3.113_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 1188 - protein, 117 aa, Artificial Sequence; identical to SEQ ID NO: 32
  Description of Artificial Sequence: Synthetic polypeptide
  VH of XENP024201

SEQ ID NO: 1189 - protein, 114 aa, Artificial Sequence
  Description of Artificial Sequence: Synthetic polypeptide
  VL of XENP024201
DVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 1190 - protein, 5 aa, Artificial Sequence
  Description of Artificial Sequence: Synthetic peptide
  XENP024201 vhCDR1
HYGMN

SEQ ID NO: 1191 - protein, 17 aa, Artificial Sequence
  Description of Artificial Sequence: Synthetic peptide
  XENP024201 vhCDR2
WINTYTGEPTYADGFTG

SEQ ID NO: 1192 - protein, 8 aa, Artificial Sequence
  Description of Artificial Sequence: Synthetic peptide
  XENP024201 vhCDR3
DYYGSSPY

SEQ ID NO: 1193 - protein, 16 aa, Artificial Sequence
  Description of Artificial Sequence: Synthetic peptide
  XENP024201 vlCDR1
KSSQSIVHSNGNTYLE

SEQ ID NO: 1194 - protein, 7 aa, Artificial Sequence
  Description of Artificial Sequence: Synthetic peptide
  XENP024201 vlCDR2
KVSNRFS

SEQ ID NO: 1195 - protein, 9 aa, Artificial Sequence
  Description of Artificial Sequence: Synthetic peptide
  XENP024201 vlCDR3
FQGSHVPNT

SEQ ID NO: 1196 - protein, 251 aa, Artificial Sequence
  Description of Artificial Sequence: Synthetic polypeptide
  XENP024202 1C11_H3_L3.115_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 1197 - protein, 117 aa, Artificial Sequence; identical to SEQ ID NO: 32
  Description of Artificial Sequence: Synthetic polypeptide
  VH of XENP024202

SEQ ID NO: 1198 - protein, 114 aa, Artificial Sequence
  Description of Artificial Sequence: Synthetic polypeptide
  VL of XENP024202
DVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 1199 - protein, 5 aa, Artificial Sequence
  Description of Artificial Sequence: Synthetic peptide
  XENP024202 vhCDR1
HYGMN

SEQ ID NO: 1200 - protein, 17 aa, Artificial Sequence
  Description of Artificial Sequence: Synthetic peptide
  XENP024202 vhCDR2
WINTYTGEPTYADGFTG

SEQ ID NO: 1201 - protein, 8 aa, Artificial Sequence
  Description of Artificial Sequence: Synthetic peptide
  XENP024202 vhCDR3
DYYGSSPY

SEQ ID NO: 1202 - protein, 16 aa, Artificial Sequence
  Description of Artificial Sequence: Synthetic peptide
  XENP024202 vlCDR1
KSSQSIVHSNGNTYLE

SEQ ID NO: 1203 - protein, 7 aa, Artificial Sequence
  Description of Artificial Sequence: Synthetic peptide
  XENP024202 vlCDR2
KVSNRFS

SEQ ID NO: 1204 - protein, 9 aa, Artificial Sequence
  Description of Artificial Sequence: Synthetic peptide
  XENP024202 vlCDR3
FQGSHVPNT

SEQ ID NO: 1205 - protein, 251 aa, Artificial Sequence
  Description of Artificial Sequence: Synthetic polypeptide
  XENP024203 1C11_H3_L3.118_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 1206 - protein, 117 aa, Artificial Sequence; identical to SEQ ID NO: 32
  Description of Artificial Sequence: Synthetic polypeptide
  VH of XENP024203

SEQ ID NO: 1207 - protein, 114 aa, Artificial Sequence
  Description of Artificial Sequence: Synthetic polypeptide
  VL of XENP024203
DVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 1208 - protein, 5 aa, Artificial Sequence
  Description of Artificial Sequence: Synthetic peptide
  XENP024203 vhCDR1
HYGMN

SEQ ID NO: 1209 - protein, 17 aa, Artificial Sequence
  Description of Artificial Sequence: Synthetic peptide
  XENP024203 vhCDR2
WINTYTGEPTYADGFTG

SEQ ID NO: 1210 - protein, 8 aa, Artificial Sequence
  Description of Artificial Sequence: Synthetic peptide
  XENP024203 vhCDR3
DYYGSSPY

SEQ ID NO: 1211 - protein, 16 aa, Artificial Sequence
  Description of Artificial Sequence: Synthetic peptide
  XENP024203 vlCDR1
KSSQSIVHSNGNTYLE

SEQ ID NO: 1212 - protein, 7 aa, Artificial Sequence
  Description of Artificial Sequence: Synthetic peptide
  XENP024203 vlCDR2
KVSSRFS

SEQ ID NO: 1213 - protein, 9 aa, Artificial Sequence
  Description of Artificial Sequence: Synthetic peptide
  XENP024203 vlCDR3
FQGSHVPNT

SEQ ID NO: 1214 - protein, 251 aa, Artificial Sequence
  Description of Artificial Sequence: Synthetic polypeptide
  XENP024204 1C11_H3_L3.119_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 1215 - protein, 117 aa, Artificial Sequence; identical to SEQ ID NO: 32
  Description of Artificial Sequence: Synthetic polypeptide
  VH of XENP024204

SEQ ID NO: 1216 - protein, 114 aa, Artificial Sequence
  Description of Artificial Sequence: Synthetic polypeptide
  VL of XENP024204
DVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 1217 - protein, 5 aa, Artificial Sequence
  Description of Artificial Sequence: Synthetic peptide
  XENP024204 vhCDR1
HYGMN

SEQ ID NO: 1218 - protein, 17 aa, Artificial Sequence
  Description of Artificial Sequence: Synthetic peptide
  XENP024204 vhCDR2
WINTYTGEPTYADGFTG

SEQ ID NO: 1219 - protein, 8 aa, Artificial Sequence
  Description of Artificial Sequence: Synthetic peptide
  XENP024204 vhCDR3
DYYGSSPY

SEQ ID NO: 1220 - protein, 16 aa, Artificial Sequence
  Description of Artificial Sequence: Synthetic peptide
  XENP024204 vlCDR1
KSSQSIVHSNGNTYLE

SEQ ID NO: 1221 - protein, 7 aa, Artificial Sequence
  Description of Artificial Sequence: Synthetic peptide
  XENP024204 vlCDR2
KVSNLFS

SEQ ID NO: 1222 - protein, 9 aa, Artificial Sequence
  Description of Artificial Sequence: Synthetic peptide
  XENP024204 vlCDR3
FQGSHVPNT

SEQ ID NO: 1223 - protein, 251 aa, Artificial Sequence
  Description of Artificial Sequence: Synthetic polypeptide
  XENP024205 1C11_H3_L3.120_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 1224 - protein, 117 aa, Artificial Sequence; identical to SEQ ID NO: 32
  Description of Artificial Sequence: Synthetic polypeptide
  VH of XENP024205

SEQ ID NO: 1225 - protein, 114 aa, Artificial Sequence
  Description of Artificial Sequence: Synthetic polypeptide
  VL of XENP024205
DVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 1226 - protein, 5 aa, Artificial Sequence
  Description of Artificial Sequence: Synthetic peptide
  XENP024205 vhCDR1
HYGMN

SEQ ID NO: 1227 - protein, 17 aa, Artificial Sequence
  Description of Artificial Sequence: Synthetic peptide
  XENP024205 vhCDR2
WINTYTGEPTYADGFTG

SEQ ID NO: 1228 - protein, 8 aa, Artificial Sequence
  Description of Artificial Sequence: Synthetic peptide
  XENP024205 vhCDR3
DYYGSSPY

SEQ ID NO: 1229 - protein, 16 aa, Artificial Sequence
  Description of Artificial Sequence: Synthetic peptide
  XENP024205 vlCDR1
KSSQSIVHSNGNTYLE

SEQ ID NO: 1230 - protein, 7 aa, Artificial Sequence
  Description of Artificial Sequence: Synthetic peptide
  XENP024205 vlCDR2
KVSNRES

SEQ ID NO: 1231 - protein, 9 aa, Artificial Sequence
  Description of Artificial Sequence: Synthetic peptide
  XENP024205 vlCDR3
FQGSHVPNT

SEQ ID NO: 1232 - protein, 251 aa, Artificial Sequence
  Description of Artificial Sequence: Synthetic polypeptide
  XENP024206 1C11_H3_L3.121_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 1233 - protein, 117 aa, Artificial Sequence; identical to SEQ ID NO: 32
  Description of Artificial Sequence: Synthetic polypeptide
  VH of XENP024206

SEQ ID NO: 1234 - protein, 114 aa, Artificial Sequence
  Description of Artificial Sequence: Synthetic polypeptide
  VL of XENP024206
DVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 1235 - protein, 5 aa, Artificial Sequence
  Description of Artificial Sequence: Synthetic peptide
  XENP024206 vhCDR1
HYGMN

SEQ ID NO: 1236 - protein, 17 aa, Artificial Sequence
  Description of Artificial Sequence: Synthetic peptide
  XENP024206 vhCDR2
WINTYTGEPTYADGFTG

SEQ ID NO: 1237 - protein, 8 aa, Artificial Sequence
  Description of Artificial Sequence: Synthetic peptide
  XENP024206 vhCDR3
DYYGSSPY

SEQ ID NO: 1238 - protein, 16 aa, Artificial Sequence
  Description of Artificial Sequence: Synthetic peptide
  XENP024206 vlCDR1
KSSQSIVHSNGNTYLE

SEQ ID NO: 1239 - protein, 7 aa, Artificial Sequence
  Description of Artificial Sequence: Synthetic peptide
  XENP024206 vlCDR2
KVSNRQS

SEQ ID NO: 1240 - protein, 9 aa, Artificial Sequence
  Description of Artificial Sequence: Synthetic peptide
  XENP024206 vlCDR3
FQGSHVPNT

SEQ ID NO: 1241 - protein, 251 aa, Artificial Sequence
  Description of Artificial Sequence: Synthetic polypeptide
  XENP024207 1C11_H3_L3.122_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 1242 - protein, 117 aa, Artificial Sequence; identical to SEQ ID NO: 32
  Description of Artificial Sequence: Synthetic polypeptide
  VH of XENP024207

SEQ ID NO: 1243 - protein, 114 aa, Artificial Sequence
  Description of Artificial Sequence: Synthetic polypeptide
  VL of XENP024207
DVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 1244 - protein, 5 aa, Artificial Sequence
  Description of Artificial Sequence: Synthetic peptide
  XENP024207 vhCDR1
HYGMN

SEQ ID NO: 1245 - protein, 17 aa, Artificial Sequence
  Description of Artificial Sequence: Synthetic peptide
  XENP024207 vhCDR2
WINTYTGEPTYADGFTG

SEQ ID NO: 1246 - protein, 8 aa, Artificial Sequence
  Description of Artificial Sequence: Synthetic peptide
  XENP024207 vhCDR3
DYYGSSPY

SEQ ID NO: 1247 - protein, 16 aa, Artificial Sequence
  Description of Artificial Sequence: Synthetic peptide
  XENP024207 vlCDR1
KSSQSIVHSNGNTYLE

SEQ ID NO: 1248 - protein, 7 aa, Artificial Sequence
  Description of Artificial Sequence: Synthetic peptide
  XENP024207 vlCDR2
KVSNRFS

SEQ ID NO: 1249 - protein, 9 aa, Artificial Sequence
  Description of Artificial Sequence: Synthetic peptide
  XENP024207 vlCDR3
FQGSHVPNT

SEQ ID NO: 1250 - protein, 251 aa, Artificial Sequence
  Description of Artificial Sequence: Synthetic polypeptide
  XENP024208 1C11_H3_L3.124_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 1251 - protein, 117 aa, Artificial Sequence; identical to SEQ ID NO: 32
  Description of Artificial Sequence: Synthetic polypeptide
  VH of XENP024208

SEQ ID NO: 1252 - protein, 114 aa, Artificial Sequence
  Description of Artificial Sequence: Synthetic polypeptide
  VL of XENP024208
DVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 1253 - protein, 5 aa, Artificial Sequence
  Description of Artificial Sequence: Synthetic peptide
  XENP024208 vhCDR1
HYGMN

SEQ ID NO: 1254 - protein, 17 aa, Artificial Sequence
  Description of Artificial Sequence: Synthetic peptide
  XENP024208 vhCDR2
WINTYTGEPTYADGFTG

SEQ ID NO: 1255 - protein, 8 aa, Artificial Sequence
  Description of Artificial Sequence: Synthetic peptide
  XENP024208 vhCDR3
DYYGSSPY

SEQ ID NO: 1256 - protein, 16 aa, Artificial Sequence
  Description of Artificial Sequence: Synthetic peptide
  XENP024208 vlCDR1
KSSQSIVHSNGNTYLE

SEQ ID NO: 1257 - protein, 7 aa, Artificial Sequence
  Description of Artificial Sequence: Synthetic peptide
  XENP024208 vlCDR2
KVSNRFS

SEQ ID NO: 1258 - protein, 9 aa, Artificial Sequence
  Description of Artificial Sequence: Synthetic peptide
  XENP024208 vlCDR3
FQGSHVPNT

SEQ ID NO: 1259 - protein, 251 aa, Artificial Sequence
  Description of Artificial Sequence: Synthetic polypeptide
  XENP024209 1C11_H3_L3.125_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 1260 - protein, 117 aa, Artificial Sequence; identical to SEQ ID NO: 32
  Description of Artificial Sequence: Synthetic polypeptide
  VH of XENP024209

SEQ ID NO: 1261 - protein, 114 aa, Artificial Sequence
  Description of Artificial Sequence: Synthetic polypeptide
  VL of XENP024209
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 1262 - protein, 5 aa, Artificial Sequence
  Description of Artificial Sequence: Synthetic peptide
  XENP024209 vhCDR1
HYGMN

SEQ ID NO: 1263 - protein, 17 aa, Artificial Sequence
  Description of Artificial Sequence: Synthetic peptide
  XENP024209 vhCDR2
WINTYTGEPTYADGFTG

SEQ ID NO: 1264 - protein, 8 aa, Artificial Sequence
  Description of Artificial Sequence: Synthetic peptide
  XENP024209 vhCDR3
DYYGSSPY

SEQ ID NO: 1265 - protein, 16 aa, Artificial Sequence
  Description of Artificial Sequence: Synthetic peptide
  XENP024209 vlCDR1
KSSQSIVHSNGNTYLE

SEQ ID NO: 1266 - protein, 7 aa, Artificial Sequence
  Description of Artificial Sequence: Synthetic peptide
  XENP024209 vlCDR2
KVSNRFS

SEQ ID NO: 1267 - protein, 9 aa, Artificial Sequence
  Description of Artificial Sequence: Synthetic peptide
  XENP024209 vlCDR3
FQGSHVPNT

SEQ ID NO: 1268 - protein, 251 aa, Artificial Sequence
  Description of Artificial Sequence: Synthetic polypeptide
  XENP024210 1C11_H3_L3.132_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 1269 - protein, 117 aa, Artificial Sequence; identical to SEQ ID NO: 32
  Description of Artificial Sequence: Synthetic polypeptide
  VH of XENP024210

SEQ ID NO: 1270 - protein, 114 aa, Artificial Sequence
  Description of Artificial Sequence: Synthetic polypeptide
  VL of XENP024210
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 1271 - protein, 5 aa, Artificial Sequence
  Description of Artificial Sequence: Synthetic peptide
  XENP024210 vhCDR1
HYGMN

SEQ ID NO: 1272 - protein, 17 aa, Artificial Sequence
  Description of Artificial Sequence: Synthetic peptide
  XENP024210 vhCDR2
WINTYTGEPTYADGFTG

SEQ ID NO: 1273 - protein, 8 aa, Artificial Sequence
  Description of Artificial Sequence: Synthetic peptide
  XENP024210 vhCDR3
DYYGSSPY

SEQ ID NO: 1274 - protein, 16 aa, Artificial Sequence
  Description of Artificial Sequence: Synthetic peptide
  XENP024210 vlCDR1
KSSQSIVHSNGNTYLE

SEQ ID NO: 1275 - protein, 7 aa, Artificial Sequence
  Description of Artificial Sequence: Synthetic peptide
  XENP024210 vlCDR2
KVSNRFS

SEQ ID NO: 1276 - protein, 9 aa, Artificial Sequence
  Description of Artificial Sequence: Synthetic peptide
  XENP024210 vlCDR3
FQGSHVPNT

SEQ ID NO: 1277 - protein, 251 aa, Artificial Sequence
  Description of Artificial Sequence: Synthetic polypeptide
  XENP024211 1C11_H3.78_L3_scFv
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1278 - protein, 117 aa, Artificial Sequence
  Description of Artificial Sequence: Synthetic polypeptide
  VH of XENP024211
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 1279 - protein, 114 aa, Artificial Sequence; identical to SEQ ID NO: 649
  Description of Artificial Sequence: Synthetic polypeptide
  VL of XENP024211

SEQ ID NO: 1280 - protein, 5 aa, Artificial Sequence
  Description of Artificial Sequence: Synthetic peptide
  XENP024211 vhCDR1
HYGMN

SEQ ID NO: 1281 - protein, 17 aa, Artificial Sequence
  Description of Artificial Sequence: Synthetic peptide
  XENP024211 vhCDR2
WINTNTGEPTYADGFTG

SEQ ID NO: 1282 - protein, 8 aa, Artificial Sequence
  Description of Artificial Sequence: Synthetic peptide
  XENP024211 vhCDR3
DYYGSSPY

SEQ ID NO: 1283 - protein, 16 aa, Artificial Sequence
  Description of Artificial Sequence: Synthetic peptide
  XENP024211 vlCDR1
KSSQSIVHSNGNTYLE

SEQ ID NO: 1284 - protein, 7 aa, Artificial Sequence
  Description of Artificial Sequence: Synthetic peptide
  XENP024211 vlCDR2
KVSNRFS

SEQ ID NO: 1285 - protein, 9 aa, Artificial Sequence
  Description of Artificial Sequence: Synthetic peptide
  XENP024211 vlCDR3
FQGSHVPNT

SEQ ID NO: 1286 - protein, 251 aa, Artificial Sequence
  Description of Artificial Sequence: Synthetic polypeptide
  XENP024212 1C11_H3.80_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1287 - protein, 117 aa, Artificial Sequence
  Description of Artificial Sequence: Synthetic polypeptide
  VH of XENP024212
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSS

SEQ ID NO: 1288 - protein, 114 aa, Artificial Sequence; identical to SEQ ID NO: 649
  Description of Artificial Sequence: Synthetic polypeptide
  VL of XENP024212

SEQ ID NO: 1289 - protein, 5 aa, Artificial Sequence
  Description of Artificial Sequence: Synthetic peptide
  XENP024212 vhCDR1
HYGMN

SEQ ID NO: 1290 - protein, 17 aa, Artificial Sequence
  Description of Artificial Sequence: Synthetic peptide
  XENP024212 vhCDR2
WINTNTGEPTYADGFTG

SEQ ID NO: 1291 - protein, 8 aa, Artificial Sequence
  Description of Artificial Sequence: Synthetic peptide
  XENP024212 vhCDR3
DYYGSSPY

SEQ ID NO: 1292 - protein, 16 aa, Artificial Sequence
  Description of Artificial Sequence: Synthetic peptide
  XENP024212 vlCDR1
KSSQSIVHSNGNTYLE

SEQ ID NO: 1293 - protein, 7 aa, Artificial Sequence
  Description of Artificial Sequence: Synthetic peptide
  XENP024212 vlCDR2
KVSNRFS

SEQ ID NO: 1294 - protein, 9 aa, Artificial Sequence
  Description of Artificial Sequence: Synthetic peptide
  XENP024212 vlCDR3
FQGSHVPNT

SEQ ID NO: 1295 - protein, 251 aa, Artificial Sequence
  Description of Artificial Sequence: Synthetic polypeptide
  XENP024213 1C11_H3.81_L3_scFv
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1296 - protein, 117 aa, Artificial Sequence
  Description of Artificial Sequence: Synthetic polypeptide
  VH of XENP024213
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSS

SEQ ID NO: 1297 - protein, 114 aa, Artificial Sequence; identical to SEQ ID NO: 649
  Description of Artificial Sequence: Synthetic polypeptide
  VL of XENP024213

SEQ ID NO: 1298 - protein, 5 aa, Artificial Sequence
  Description of Artificial Sequence: Synthetic peptide
  XENP024213 vhCDR1
HYGMN

SEQ ID NO: 1299 - protein, 17 aa, Artificial Sequence
  Description of Artificial Sequence: Synthetic peptide
  XENP024213 vhCDR2
WINTYTGEPTYADKFKG

SEQ ID NO: 1300 - protein, 8 aa, Artificial Sequence
  Description of Artificial Sequence: Synthetic peptide
  XENP024213 vhCDR3
DYYGSSPY

SEQ ID NO: 1301 - protein, 16 aa, Artificial Sequence
  Description of Artificial Sequence: Synthetic peptide
  XENP024213 vlCDR1
KSSQSIVHSNGNTYLE

SEQ ID NO: 1302 - protein, 7 aa, Artificial Sequence
  Description of Artificial Sequence: Synthetic peptide
  XENP024213 vlCDR2
KVSNRFS

SEQ ID NO: 1303 - protein, 9 aa, Artificial Sequence
  Description of Artificial Sequence: Synthetic peptide
  XENP024213 vlCDR3
FQGSHVPNT

SEQ ID NO: 1304 - protein, 251 aa, Artificial Sequence
  Description of Artificial Sequence: Synthetic polypeptide
  XENP024214 1C11_H3.82_L3_scFv
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1305 - protein, 117 aa, Artificial Sequence
  Description of Artificial Sequence: Synthetic polypeptide
  VH of XENP024214
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSS

SEQ ID NO: 1306 - protein, 114 aa, Artificial Sequence; identical to SEQ ID NO: 649
  Description of Artificial Sequence: Synthetic polypeptide
  VL of XENP024214

SEQ ID NO: 1307 - protein, 5 aa, Artificial Sequence
  Description of Artificial Sequence: Synthetic peptide
  XENP024214 vhCDR1
HYGMN

SEQ ID NO: 1308 - protein, 17 aa, Artificial Sequence
  Description of Artificial Sequence: Synthetic peptide
  XENP024214 vhCDR2
WINTYTGEPTYADKFQG

SEQ ID NO: 1309 - protein, 8 aa, Artificial Sequence
  Description of Artificial Sequence: Synthetic peptide
  XENP024214 vhCDR3
DYYGSSPY

SEQ ID NO: 1310 - protein, 16 aa, Artificial Sequence
  Description of Artificial Sequence: Synthetic peptide
  XENP024214 vlCDR1
KSSQSIVHSNGNTYLE

SEQ ID NO: 1311 - protein, 7 aa, Artificial Sequence
  Description of Artificial Sequence: Synthetic peptide
  XENP024214 vlCDR2
KVSNRFS

SEQ ID NO: 1312 - protein, 9 aa, Artificial Sequence
  Description of Artificial Sequence: Synthetic peptide
  XENP024214 vlCDR3
FQGSHVPNT

SEQ ID NO: 1313 - protein, 251 aa, Artificial Sequence
  Description of Artificial Sequence: Synthetic polypeptide
  XENP024215 1C11_H3.83_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1314 - protein, 117 aa, Artificial Sequence
  Description of Artificial Sequence: Synthetic polypeptide
  VH of XENP024215
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 1315 - protein, 114 aa, Artificial Sequence; identical to SEQ ID NO: 649
  Description of Artificial Sequence: Synthetic polypeptide
  VL of XENP024215

SEQ ID NO: 1316 - protein, 5 aa, Artificial Sequence
  Description of Artificial Sequence: Synthetic peptide
  XENP024215 vhCDR1
HYGMN

SEQ ID NO: 1317 - protein, 17 aa, Artificial Sequence
  Description of Artificial Sequence: Synthetic peptide
  XENP024215 vhCDR2
WINTNTGEPTYADGFTG

SEQ ID NO: 1318 - protein, 8 aa, Artificial Sequence
  Description of Artificial Sequence: Synthetic peptide
  XENP024215 vhCDR3
DYYGSSPY

SEQ ID NO: 1319 - protein, 16 aa, Artificial Sequence
  Description of Artificial Sequence: Synthetic peptide
  XENP024215 vlCDR1
KSSQSIVHSNGNTYLE

SEQ ID NO: 1320 - protein, 7 aa, Artificial Sequence
  Description of Artificial Sequence: Synthetic peptide
  XENP024215 vlCDR2
KVSNRFS

SEQ ID NO: 1321 - protein, 9 aa, Artificial Sequence
  Description of Artificial Sequence: Synthetic peptide
  XENP024215 vlCDR3
FQGSHVPNT

SEQ ID NO: 1322 - protein, 251 aa, Artificial Sequence
  Description of Artificial Sequence: Synthetic polypeptide
  XENP024216 1C11_H3.84_L3_scFv
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1323 - protein, 117 aa, Artificial Sequence
  Description of Artificial Sequence: Synthetic polypeptide
  VH of XENP024216
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSS

SEQ ID NO: 1324 - protein, 114 aa, Artificial Sequence; identical to SEQ ID NO: 649
  Description of Artificial Sequence: Synthetic polypeptide
  VL of XENP024216

SEQ ID NO: 1325 - protein, 5 aa, Artificial Sequence
  Description of Artificial Sequence: Synthetic peptide
  XENP024216 vhCDR1
HYGMN

SEQ ID NO: 1326 - protein, 17 aa, Artificial Sequence
  Description of Artificial Sequence: Synthetic peptide
  XENP024216 vhCDR2
WINTYTGEPTYADKFKG

SEQ ID NO: 1327 - protein, 8 aa, Artificial Sequence
  Description of Artificial Sequence: Synthetic peptide
  XENP024216 vhCDR3
DYYGSSPY

SEQ ID NO: 1328 - protein, 16 aa, Artificial Sequence
  Description of Artificial Sequence: Synthetic peptide
  XENP024216 vlCDR1
KSSQSIVHSNGNTYLE

SEQ ID NO: 1329 - protein, 7 aa, Artificial Sequence
  Description of Artificial Sequence: Synthetic peptide
  XENP024216 vlCDR2
KVSNRFS

SEQ ID NO: 1330 - protein, 9 aa, Artificial Sequence
  Description of Artificial Sequence: Synthetic peptide
  XENP024216 vlCDR3
FQGSHVPNT

SEQ ID NO: 1331 - protein, 251 aa, Artificial Sequence
  Description of Artificial Sequence: Synthetic polypeptide
  XENP024217 1C11_H3.85_L3_scFv
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1332 - protein, 117 aa, Artificial Sequence
  Description of Artificial Sequence: Synthetic polypeptide
  VH of XENP024217
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSS

SEQ ID NO: 1333 - protein, 114 aa, Artificial Sequence; identical to SEQ ID NO: 649
  Description of Artificial Sequence: Synthetic polypeptide
  VL of XENP024217

SEQ ID NO: 1334 - protein, 5 aa, Artificial Sequence
  Description of Artificial Sequence: Synthetic peptide
  XENP024217 vhCDR1
HYGMN

SEQ ID NO: 1335 - protein, 17 aa, Artificial Sequence
  Description of Artificial Sequence: Synthetic peptide
  XENP024217 vhCDR2
WINTYTGEPTYADKFQG

SEQ ID NO: 1336 - protein, 8 aa, Artificial Sequence
  Description of Artificial Sequence: Synthetic peptide
  XENP024217 vhCDR3
DYYGSSPY

SEQ ID NO: 1337 - protein, 16 aa, Artificial Sequence
  Description of Artificial Sequence: Synthetic peptide
  XENP024217 vlCDR1
KSSQSIVHSNGNTYLE

SEQ ID NO: 1338 - protein, 7 aa, Artificial Sequence
  Description of Artificial Sequence: Synthetic peptide
  XENP024217 vlCDR2
KVSNRFS

SEQ ID NO: 1339 - protein, 9 aa, Artificial Sequence
  Description of Artificial Sequence: Synthetic peptide
  XENP024217 vlCDR3
FQGSHVPNT

SEQ ID NO: 1340 - protein, 251 aa, Artificial Sequence
  Description of Artificial Sequence: Synthetic polypeptide
  XENP024218 1C11_H3.86_L3_scFv
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1341 - protein, 117 aa, Artificial Sequence
  Description of Artificial Sequence: Synthetic polypeptide
  VH of XENP024218
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1342 - protein, 114 aa, Artificial Sequence; identical to SEQ ID NO: 649
  Description of Artificial Sequence: Synthetic polypeptide
  VL of XENP024218

SEQ ID NO: 1343 - protein, 5 aa, Artificial Sequence
  Description of Artificial Sequence: Synthetic peptide
  XENP024218 vhCDR1
HYGMN

SEQ ID NO: 1344 - protein, 17 aa, Artificial Sequence
  Description of Artificial Sequence: Synthetic peptide
  XENP024218 vhCDR2
WINTYTGEPTYADGFTG

SEQ ID NO: 1345 - protein, 8 aa, Artificial Sequence
  Description of Artificial Sequence: Synthetic peptide
  XENP024218 vhCDR3
DYYGSSPY

SEQ ID NO: 1346 - protein, 16 aa, Artificial Sequence
  Description of Artificial Sequence: Synthetic peptide
  XENP024218 vlCDR1
KSSQSIVHSNGNTYLE

SEQ ID NO: 1347 - protein, 7 aa, Artificial Sequence
  Description of Artificial Sequence: Synthetic peptide
  XENP024218 vlCDR2
KVSNRFS

SEQ ID NO: 1348 - protein, 9 aa, Artificial Sequence
  Description of Artificial Sequence: Synthetic peptide
  XENP024218 vlCDR3
FQGSHVPNT

SEQ ID NO: 1349 - protein, 251 aa, Artificial Sequence
  Description of Artificial Sequence: Synthetic polypeptide
  XENP024219 1C11_H3.88_L3_scFv
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1350 - protein, 117 aa, Artificial Sequence
  Description of Artificial Sequence: Synthetic polypeptide
  VH of XENP024219
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1351 - protein, 114 aa, Artificial Sequence; identical to SEQ ID NO: 649
  Description of Artificial Sequence: Synthetic polypeptide
  VL of XENP024219

SEQ ID NO: 1352 - protein, 5 aa, Artificial Sequence
  Description of Artificial Sequence: Synthetic peptide
  XENP024219 vhCDR1
HYGMN

SEQ ID NO: 1353 - protein, 17 aa, Artificial Sequence
  Description of Artificial Sequence: Synthetic peptide
  XENP024219 vhCDR2
WINTYTGEPTYADGFTG

SEQ ID NO: 1354 - protein, 8 aa, Artificial Sequence
  Description of Artificial Sequence: Synthetic peptide
  XENP024219 vhCDR3
DYYGSSPY

SEQ ID NO: 1355 - protein, 16 aa, Artificial Sequence
  Description of Artificial Sequence: Synthetic peptide
  XENP024219 vlCDR1
KSSQSIVHSNGNTYLE

SEQ ID NO: 1356 - protein, 7 aa, Artificial Sequence
  Description of Artificial Sequence: Synthetic peptide
  XENP024219 vlCDR2
KVSNRFS

SEQ ID NO: 1357 - protein, 9 aa, Artificial Sequence
  Description of Artificial Sequence: Synthetic peptide
  XENP024219 vlCDR3
FQGSHVPNT

SEQ ID NO: 1358 - protein, 251 aa, Artificial Sequence
  Description of Artificial Sequence: Synthetic polypeptide
  XENP024220 1C11_H3.89_L3_scFv
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1359 - protein, 117 aa, Artificial Sequence
  Description of Artificial Sequence: Synthetic polypeptide
  VH of XENP024220
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1360 - protein, 114 aa, Artificial Sequence; identical to SEQ ID NO: 649
  Description of Artificial Sequence: Synthetic polypeptide
  VL of XENP024220

SEQ ID NO: 1361 - protein, 5 aa, Artificial Sequence
  Description of Artificial Sequence: Synthetic peptide
  XENP024220 vhCDR1
HYGMN

SEQ ID NO: 1362 - protein, 17 aa, Artificial Sequence
  Description of Artificial Sequence: Synthetic peptide
  XENP024220 vhCDR2
WINTYTGEPTYADGFTG

SEQ ID NO: 1363 - protein, 8 aa, Artificial Sequence
  Description of Artificial Sequence: Synthetic peptide
  XENP024220 vhCDR3
DYYGSSPY

SEQ ID NO: 1364 - protein, 16 aa, Artificial Sequence
  Description of Artificial Sequence: Synthetic peptide
  XENP024220 vlCDR1
KSSQSIVHSNGNTYLE

SEQ ID NO: 1365 - protein, 7 aa, Artificial Sequence
  Description of Artificial Sequence: Synthetic peptide
  XENP024220 vlCDR2
KVSNRFS

SEQ ID NO: 1366 - protein, 9 aa, Artificial Sequence
  Description of Artificial Sequence: Synthetic peptide
  XENP024220 vlCDR3
FQGSHVPNT

SEQ ID NO: 1367 - protein, 251 aa, Artificial Sequence
  Description of Artificial Sequence: Synthetic polypeptide
  XENP024221 1C11_H3.90_L3_scFv
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1368 - protein, 117 aa, Artificial Sequence
  Description of Artificial Sequence: Synthetic polypeptide
  VH of XENP024221
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1369 - protein, 114 aa, Artificial Sequence; identical to SEQ ID NO: 649
  Description of Artificial Sequence: Synthetic polypeptide
  VL of XENP024221

SEQ ID NO: 1370 - protein, 5 aa, Artificial Sequence
  Description of Artificial Sequence: Synthetic peptide
  XENP024221 vhCDR1
HYGMN

SEQ ID NO: 1371 - protein, 17 aa, Artificial Sequence
  Description of Artificial Sequence: Synthetic peptide
  XENP024221 vhCDR2
WINTYTGEPTYADGFTG

SEQ ID NO: 1372 - protein, 8 aa, Artificial Sequence
  Description of Artificial Sequence: Synthetic peptide
  XENP024221 vhCDR3
DYYGSSPY

SEQ ID NO: 1373 - protein, 16 aa, Artificial Sequence
  Description of Artificial Sequence: Synthetic peptide
  XENP024221 vlCDR1
KSSQSIVHSNGNTYLE

SEQ ID NO: 1374 - protein, 7 aa, Artificial Sequence
  Description of Artificial Sequence: Synthetic peptide
  XENP024221 vlCDR2
KVSNRFS

SEQ ID NO: 1375 - protein, 9 aa, Artificial Sequence
  Description of Artificial Sequence: Synthetic peptide
  XENP024221 vlCDR3
FQGSHVPNT

SEQ ID NO: 1376 - protein, 251 aa, Artificial Sequence
  Description of Artificial Sequence: Synthetic polypeptide
  XENP024222 1C11_H3.91_L3_scFv
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1377 - protein, 117 aa, Artificial Sequence
  Description of Artificial Sequence: Synthetic polypeptide
  VH of XENP024222
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1378 - protein, 114 aa, Artificial Sequence; identical to SEQ ID NO: 649
  Description of Artificial Sequence: Synthetic polypeptide
  VL of XENP024222

SEQ ID NO: 1379 - protein, 5 aa, Artificial Sequence
  Description of Artificial Sequence: Synthetic peptide
  XENP024222 vhCDR1
HYGMN

SEQ ID NO: 1380 - protein, 17 aa, Artificial Sequence
  Description of Artificial Sequence: Synthetic peptide
  XENP024222 vhCDR2
WINTYTGEPTYADGFTG

SEQ ID NO: 1381 - protein, 8 aa, Artificial Sequence
  Description of Artificial Sequence: Synthetic peptide
  XENP024222 vhCDR3
DYYGSSPY

SEQ ID NO: 1382 - protein, 16 aa, Artificial Sequence
  Description of Artificial Sequence: Synthetic peptide
  XENP024222 vlCDR1
KSSQSIVHSNGNTYLE

SEQ ID NO: 1383 - protein, 7 aa, Artificial Sequence
  Description of Artificial Sequence: Synthetic peptide
  XENP024222 vlCDR2
KVSNRFS

SEQ ID NO: 1384 - protein, 9 aa, Artificial Sequence
  Description of Artificial Sequence: Synthetic peptide
  XENP024222 vlCDR3
FQGSHVPNT

SEQ ID NO: 1385 - protein, 251 aa, Artificial Sequence
  Description of Artificial Sequence: Synthetic polypeptide
  XENP024223 1C11_H3.92_L3_scFv
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1386 - protein, 117 aa, Artificial Sequence
  Description of Artificial Sequence: Synthetic polypeptide
  VH of XENP024223
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1387 - protein, 114 aa, Artificial Sequence; identical to SEQ ID NO: 649
  Description of Artificial Sequence: Synthetic polypeptide
  VL of XENP024223

SEQ ID NO: 1388 - protein, 5 aa, Artificial Sequence
  Description of Artificial Sequence: Synthetic peptide
  XENP024223 vhCDR1
HYGMN

SEQ ID NO: 1389 - protein, 17 aa, Artificial Sequence
  Description of Artificial Sequence: Synthetic peptide
  XENP024223 vhCDR2
WINTYTGEPTYADGFTG

SEQ ID NO: 1390 - protein, 8 aa, Artificial Sequence
  Description of Artificial Sequence: Synthetic peptide
  XENP024223 vhCDR3
DYYGSSPY

SEQ ID NO: 1391 - protein, 16 aa, Artificial Sequence
  Description of Artificial Sequence: Synthetic peptide
  XENP024223 vlCDR1
KSSQSIVHSNGNTYLE

SEQ ID NO: 1392 - protein, 7 aa, Artificial Sequence
  Description of Artificial Sequence: Synthetic peptide
  XENP024223 vlCDR2
KVSNRFS

SEQ ID NO: 1393 - protein, 9 aa, Artificial Sequence
  Description of Artificial Sequence: Synthetic peptide
  XENP024223 vlCDR3
FQGSHVPNT

SEQ ID NO: 1394 - protein, 251 aa, Artificial Sequence
  Description of Artificial Sequence: Synthetic polypeptide
  XENP024224 1C11_H3.93_L3_scFv
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1395 - protein, 117 aa, Artificial Sequence
  Description of Artificial Sequence: Synthetic polypeptide
  VH of XENP024224
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1396 - protein, 114 aa, Artificial Sequence; identical to SEQ ID NO: 649
  Description of Artificial Sequence: Synthetic polypeptide
  VL of XENP024224

SEQ ID NO: 1397 - protein, 5 aa, Artificial Sequence
  Description of Artificial Sequence: Synthetic peptide
  XENP024224 vhCDR1
HYGMN

SEQ ID NO: 1398 - protein, 17 aa, Artificial Sequence
  Description of Artificial Sequence: Synthetic peptide
  XENP024224 vhCDR2
WINTYTGEPTYADGFTG

SEQ ID NO: 1399 - protein, 8 aa, Artificial Sequence
  Description of Artificial Sequence: Synthetic peptide
  XENP024224 vhCDR3
DYYGSSPY

SEQ ID NO: 1400 - protein, 16 aa, Artificial Sequence
  Description of Artificial Sequence: Synthetic peptide
  XENP024224 vlCDR1
KSSQSIVHSNGNTYLE

SEQ ID NO: 1401 - protein, 7 aa, Artificial Sequence
  Description of Artificial Sequence: Synthetic peptide
  XENP024224 vlCDR2
KVSNRFS

SEQ ID NO: 1402 - protein, 9 aa, Artificial Sequence
  Description of Artificial Sequence: Synthetic peptide
  XENP024224 vlCDR3
FQGSHVPNT

SEQ ID NO: 1403 - protein, 251 aa, Artificial Sequence
  Description of Artificial Sequence: Synthetic polypeptide
  XENP024225 1C11_H3.94_L3_scFv
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1404 - protein, 117 aa, Artificial Sequence
  Description of Artificial Sequence: Synthetic polypeptide
  VH of XENP024225
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1405 - protein, 114 aa, Artificial Sequence; identical to SEQ ID NO: 649
  Description of Artificial Sequence: Synthetic polypeptide
  VL of XENP024225

SEQ ID NO: 1406 - protein, 5 aa, Artificial Sequence
  Description of Artificial Sequence: Synthetic peptide
  XENP024225 vhCDR1
HYGMN

SEQ ID NO: 1407 - protein, 17 aa, Artificial Sequence
  Description of Artificial Sequence: Synthetic peptide
  XENP024225 vhCDR2
WINTYTGEPTYADGFTG

SEQ ID NO: 1408 - protein, 8 aa, Artificial Sequence
  Description of Artificial Sequence: Synthetic peptide
  XENP024225 vhCDR3
DYYGSSPY

SEQ ID NO: 1409 - protein, 16 aa, Artificial Sequence
  Description of Artificial Sequence: Synthetic peptide
  XENP024225 vlCDR1
KSSQSIVHSNGNTYLE

SEQ ID NO: 1410 - protein, 7 aa, Artificial Sequence
  Description of Artificial Sequence: Synthetic peptide
  XENP024225 vlCDR2
KVSNRFS

SEQ ID NO: 1411 - protein, 9 aa, Artificial Sequence
  Description of Artificial Sequence: Synthetic peptide
  XENP024225 vlCDR3
FQGSHVPNT

SEQ ID NO: 1412 - protein, 251 aa, Artificial Sequence
  Description of Artificial Sequence: Synthetic polypeptide
  XENP024226 1C11_H3.95_L3_scFv
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1413 - protein, 117 aa, Artificial Sequence
  Description of Artificial Sequence: Synthetic polypeptide
  VH of XENP024226
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1414 - protein, 114 aa, Artificial Sequence; identical to SEQ ID NO: 649
  Description of Artificial Sequence: Synthetic polypeptide
  VL of XENP024226

SEQ ID NO: 1415 - protein, 5 aa, Artificial Sequence
  Description of Artificial Sequence: Synthetic peptide
  XENP024226 vhCDR1
HYGMN

SEQ ID NO: 1416 - protein, 17 aa, Artificial Sequence
  Description of Artificial Sequence: Synthetic peptide
  XENP024226 vhCDR2
WINTYTGEPTYADGFTG

SEQ ID NO: 1417 - protein, 8 aa, Artificial Sequence
  Description of Artificial Sequence: Synthetic peptide
  XENP024226 vhCDR3
DYYGSSPY

SEQ ID NO: 1418 - protein, 16 aa, Artificial Sequence
  Description of Artificial Sequence: Synthetic peptide
  XENP024226 vlCDR1
KSSQSIVHSNGNTYLE

SEQ ID NO: 1419 - protein, 7 aa, Artificial Sequence
  Description of Artificial Sequence: Synthetic peptide
  XENP024226 vlCDR2
KVSNRFS

SEQ ID NO: 1420 - protein, 9 aa, Artificial Sequence
  Description of Artificial Sequence: Synthetic peptide
  XENP024226 vlCDR3
FQGSHVPNT

SEQ ID NO: 1421 - protein, 251 aa, Artificial Sequence
  Description of Artificial Sequence: Synthetic polypeptide
  XENP024227 1C11_H3.96_L3_scFv
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1422 - protein, 117 aa, Artificial Sequence
  Description of Artificial Sequence: Synthetic polypeptide
  VH of XENP024227
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1423 - protein, 114 aa, Artificial Sequence; identical to SEQ ID NO: 649
  Description of Artificial Sequence: Synthetic polypeptide
  VL of XENP024227

SEQ ID NO: 1424 - protein, 5 aa, Artificial Sequence
  Description of Artificial Sequence: Synthetic peptide
  XENP024227 vhCDR1
HYGMN

SEQ ID NO: 1425 - protein, 17 aa, Artificial Sequence
  Description of Artificial Sequence: Synthetic peptide
  XENP024227 vhCDR2
WINTYTGEPTYADGFTG

SEQ ID NO: 1426 - protein, 8 aa, Artificial Sequence
  Description of Artificial Sequence: Synthetic peptide
  XENP024227 vhCDR3
DYYGSSPY

SEQ ID NO: 1427 - protein, 16 aa, Artificial Sequence
  Description of Artificial Sequence: Synthetic peptide
  XENP024227 vlCDR1
KSSQSIVHSNGNTYLE

SEQ ID NO: 1428 - protein, 7 aa, Artificial Sequence
  Description of Artificial Sequence: Synthetic peptide
  XENP024227 vlCDR2
KVSNRFS

SEQ ID NO: 1429 - protein, 9 aa, Artificial Sequence
  Description of Artificial Sequence: Synthetic peptide
  XENP024227 vlCDR3
FQGSHVPNT

SEQ ID NO: 1430 - protein, 251 aa, Artificial Sequence
  Description of Artificial Sequence: Synthetic polypeptide
  XENP024228 1C11_H3.97_L3_scFv
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1431 - protein, 117 aa, Artificial Sequence
  Description of Artificial Sequence: Synthetic polypeptide
  VH of XENP024228
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1432 - protein, 114 aa, Artificial Sequence; identical to SEQ ID NO: 649
  Description of Artificial Sequence: Synthetic polypeptide
  VL of XENP024228

SEQ ID NO: 1433 - protein, 5 aa, Artificial Sequence
  Description of Artificial Sequence: Synthetic peptide
  XENP024228 vhCDR1
HYGMN

SEQ ID NO: 1434 - protein, 17 aa, Artificial Sequence
  Description of Artificial Sequence: Synthetic peptide
  XENP024228 vhCDR2
WINTYTGEPTYADGFTG

SEQ ID NO: 1435 - protein, 8 aa, Artificial Sequence
  Description of Artificial Sequence: Synthetic peptide
  XENP024228 vhCDR3
DYYGSSPY

SEQ ID NO: 1436 - protein, 16 aa, Artificial Sequence
  Description of Artificial Sequence: Synthetic peptide
  XENP024228 vlCDR1
KSSQSIVHSNGNTYLE

SEQ ID NO: 1437 - protein, 7 aa, Artificial Sequence
  Description of Artificial Sequence: Synthetic peptide
  XENP024228 vlCDR2
KVSNRFS

SEQ ID NO: 1438 - protein, 9 aa, Artificial Sequence
  Description of Artificial Sequence: Synthetic peptide
  XENP024228 vlCDR3
FQGSHVPNT

SEQ ID NO: 1439 - protein, 251 aa, Artificial Sequence
  Description of Artificial Sequence: Synthetic polypeptide
  XENP024229 1C11_H3.98_L3_scFv
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1440 - protein, 117 aa, Artificial Sequence
  Description of Artificial Sequence: Synthetic polypeptide
  VH of XENP024229
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1441 - protein, 114 aa, Artificial Sequence; identical to SEQ ID NO: 649
  Description of Artificial Sequence: Synthetic polypeptide
  VL of XENP024229

SEQ ID NO: 1442 - protein, 5 aa, Artificial Sequence
  Description of Artificial Sequence: Synthetic peptide
  XENP024229 vhCDR1
HYGMN

SEQ ID NO: 1443 - protein, 17 aa, Artificial Sequence
  Description of Artificial Sequence: Synthetic peptide
  XENP024229 vhCDR2
WINTYTGEPTYADGFTG

SEQ ID NO: 1444 - protein, 8 aa, Artificial Sequence
  Description of Artificial Sequence: Synthetic peptide
  XENP024229 vhCDR3
DYYGSSPY

SEQ ID NO: 1445 - protein, 16 aa, Artificial Sequence
  Description of Artificial Sequence: Synthetic peptide
  XENP024229 vlCDR1
KSSQSIVHSNGNTYLE

SEQ ID NO: 1446 - protein, 7 aa, Artificial Sequence
  Description of Artificial Sequence: Synthetic peptide
  XENP024229 vlCDR2
KVSNRFS

SEQ ID NO: 1447 - protein, 9 aa, Artificial Sequence
  Description of Artificial Sequence: Synthetic peptide
  XENP024229 vlCDR3
FQGSHVPNT

SEQ ID NO: 1448 - protein, 251 aa, Artificial Sequence
  Description of Artificial Sequence: Synthetic polypeptide
  XENP024230 1C11_H3.99_L3_scFv
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1449 - protein, 117 aa, Artificial Sequence
  Description of Artificial Sequence: Synthetic polypeptide
  VH of XENP024230
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1450 - protein, 114 aa, Artificial Sequence; identical to SEQ ID NO: 649
  Description of Artificial Sequence: Synthetic polypeptide
  VL of XENP024230

SEQ ID NO: 1451 - protein, 5 aa, Artificial Sequence
  Description of Artificial Sequence: Synthetic peptide
  XENP024230 vhCDR1
HYGMN

SEQ ID NO: 1452 - protein, 17 aa, Artificial Sequence
  Description of Artificial Sequence: Synthetic peptide
  XENP024230 vhCDR2
WINTYTGEPTYADGFTG

SEQ ID NO: 1453 - protein, 8 aa, Artificial Sequence
  Description of Artificial Sequence: Synthetic peptide
  XENP024230 vhCDR3
DYYGSSPY

SEQ ID NO: 1454 - protein, 16 aa, Artificial Sequence
  Description of Artificial Sequence: Synthetic peptide
  XENP024230 vlCDR1
KSSQSIVHSNGNTYLE

SEQ ID NO: 1455 - protein, 7 aa, Artificial Sequence
  Description of Artificial Sequence: Synthetic peptide
  XENP024230 vlCDR2
KVSNRFS

SEQ ID NO: 1456 - protein, 9 aa, Artificial Sequence
  Description of Artificial Sequence: Synthetic peptide
  XENP024230 vlCDR3
FQGSHVPNT

SEQ ID NO: 1457 - protein, 251 aa, Artificial Sequence
  Description of Artificial Sequence: Synthetic polypeptide
  XENP024231 1C11_H3.100_L3_scFv
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1458 - protein, 117 aa, Artificial Sequence
  Description of Artificial Sequence: Synthetic polypeptide
  VH of XENP024231
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1459 - protein, 114 aa, Artificial Sequence; identical to SEQ ID NO: 649
  Description of Artificial Sequence: Synthetic polypeptide
  VL of XENP024231

SEQ ID NO: 1460 - protein, 5 aa, Artificial Sequence
  Description of Artificial Sequence: Synthetic peptide
  XENP024231 vhCDR1
HYGMN

SEQ ID NO: 1461 - protein, 17 aa, Artificial Sequence
  Description of Artificial Sequence: Synthetic peptide
  XENP024231 vhCDR2
WINTYTGEPTYADGFTG

SEQ ID NO: 1462 - protein, 8 aa, Artificial Sequence
  Description of Artificial Sequence: Synthetic peptide
  XENP024231 vhCDR3
DYYGSSPY

SEQ ID NO: 1463 - protein, 16 aa, Artificial Sequence
  Description of Artificial Sequence: Synthetic peptide
  XENP024231 vlCDR1
KSSQSIVHSNGNTYLE

SEQ ID NO: 1464 - protein, 7 aa, Artificial Sequence
  Description of Artificial Sequence: Synthetic peptide
  XENP024231 vlCDR2
KVSNRFS

SEQ ID NO: 1465 - protein, 9 aa, Artificial Sequence
  Description of Artificial Sequence: Synthetic peptide
  XENP024231 vlCDR3
FQGSHVPNT

SEQ ID NO: 1466 - protein, 251 aa, Artificial Sequence
  Description of Artificial Sequence: Synthetic polypeptide
  XENP024232 1C11_H3.101_L3_scFv
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1467 - protein, 117 aa, Artificial Sequence
  Description of Artificial Sequence: Synthetic polypeptide
  VH of XENP024232
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1468 - protein, 114 aa, Artificial Sequence; identical to SEQ ID NO: 649
  Description of Artificial Sequence: Synthetic polypeptide
  VL of XENP024232

SEQ ID NO: 1469 - protein, 5 aa, Artificial Sequence
  Description of Artificial Sequence: Synthetic peptide
  XENP024232 vhCDR1
HYGMN

SEQ ID NO: 1470 - protein, 17 aa, Artificial Sequence
  Description of Artificial Sequence: Synthetic peptide
  XENP024232 vhCDR2
WINTYTGEPTYADGFTG

SEQ ID NO: 1471 - protein, 8 aa, Artificial Sequence
  Description of Artificial Sequence: Synthetic peptide
  XENP024232 vhCDR3
DYYGSSPY

SEQ ID NO: 1472 - protein, 16 aa, Artificial Sequence
  Description of Artificial Sequence: Synthetic peptide
  XENP024232 vlCDR1
KSSQSIVHSNGNTYLE

SEQ ID NO: 1473 - protein, 7 aa, Artificial Sequence
  Description of Artificial Sequence: Synthetic peptide
  XENP024232 vlCDR2
KVSNRFS

SEQ ID NO: 1474 - protein, 9 aa, Artificial Sequence
  Description of Artificial Sequence: Synthetic peptide
  XENP024232 vlCDR3
FQGSHVPNT

SEQ ID NO: 1475 - protein, 251 aa, Artificial Sequence
  Description of Artificial Sequence: Synthetic polypeptide
  XENP024233 1C11_H3.102_L3_scFv
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1476 - protein, 117 aa, Artificial Sequence
  Description of Artificial Sequence: Synthetic polypeptide
  VH of XENP024233
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1477 - protein, 114 aa, Artificial Sequence; identical to SEQ ID NO: 649
  Description of Artificial Sequence: Synthetic polypeptide
  VL of XENP024233

SEQ ID NO: 1478 - protein, 5 aa, Artificial Sequence
  Description of Artificial Sequence: Synthetic peptide
  XENP024233 vhCDR1
HYGMN

SEQ ID NO: 1479 - protein, 17 aa, Artificial Sequence
  Description of Artificial Sequence: Synthetic peptide
  XENP024233 vhCDR2
WINTYTGEPTYADGFTG

SEQ ID NO: 1480 - protein, 8 aa, Artificial Sequence
  Description of Artificial Sequence: Synthetic peptide
  XENP024233 vhCDR3
DYYGSSPY

SEQ ID NO: 1481 - protein, 16 aa, Artificial Sequence
  Description of Artificial Sequence: Synthetic peptide
  XENP024233 vlCDR1
KSSQSIVHSNGNTYLE

SEQ ID NO: 1482 - protein, 7 aa, Artificial Sequence
  Description of Artificial Sequence: Synthetic peptide
  XENP024233 vlCDR2
KVSNRFS

SEQ ID NO: 1483 - protein, 9 aa, Artificial Sequence
  Description of Artificial Sequence: Synthetic peptide
  XENP024233 vlCDR3
FQGSHVPNT

SEQ ID NO: 1484 - protein, 251 aa, Artificial Sequence
  Description of Artificial Sequence: Synthetic polypeptide
  XENP024234 1C11_H3.103_L3_scFv
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1485 - protein, 117 aa, Artificial Sequence
  Description of Artificial Sequence: Synthetic polypeptide
  VH of XENP024234
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1486 - protein, 114 aa, Artificial Sequence; identical to SEQ ID NO: 649
  Description of Artificial Sequence: Synthetic polypeptide
  VL of XENP024234

SEQ ID NO: 1487 - protein, 5 aa, Artificial Sequence
  Description of Artificial Sequence: Synthetic peptide
  XENP024234 vhCDR1
HYGMN

SEQ ID NO: 1488 - protein, 17 aa, Artificial Sequence
  Description of Artificial Sequence: Synthetic peptide
  XENP024234 vhCDR2
WINTYTGEPTYADGFTG

SEQ ID NO: 1489 - protein, 8 aa, Artificial Sequence
  Description of Artificial Sequence: Synthetic peptide
  XENP024234 vhCDR3
DYYGSSPY

SEQ ID NO: 1490 - protein, 16 aa, Artificial Sequence
  Description of Artificial Sequence: Synthetic peptide
  XENP024234 vlCDR1
KSSQSIVHSNGNTYLE

SEQ ID NO: 1491 - protein, 7 aa, Artificial Sequence
  Description of Artificial Sequence: Synthetic peptide
  XENP024234 vlCDR2
KVSNRFS

SEQ ID NO: 1492 - protein, 9 aa, Artificial Sequence
  Description of Artificial Sequence: Synthetic peptide
  XENP024234 vlCDR3
FQGSHVPNT

SEQ ID NO: 1493 - protein, 251 aa, Artificial Sequence
  Description of Artificial Sequence: Synthetic polypeptide
  XENP024235 1C11_H3.104_L3_scFv
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1494 - protein, 117 aa, Artificial Sequence
  Description of Artificial Sequence: Synthetic polypeptide
  VH of XENP024235
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1495 - protein, 114 aa, Artificial Sequence; identical to SEQ ID NO: 649
  Description of Artificial Sequence: Synthetic polypeptide
  VL of XENP024235

SEQ ID NO: 1496 - protein, 5 aa, Artificial Sequence
  Description of Artificial Sequence: Synthetic peptide
  XENP024235 vhCDR1
HYGMN

SEQ ID NO: 1497 - protein, 17 aa, Artificial Sequence
  Description of Artificial Sequence: Synthetic peptide
  XENP024235 vhCDR2
WINTYTGEPTYADGFTG

SEQ ID NO: 1498 - protein, 8 aa, Artificial Sequence
  Description of Artificial Sequence: Synthetic peptide
  XENP024235 vhCDR3
DYYGSSPY

SEQ ID NO: 1499 - protein, 16 aa, Artificial Sequence
  Description of Artificial Sequence: Synthetic peptide
  XENP024235 vlCDR1
KSSQSIVHSNGNTYLE

SEQ ID NO: 1500 - protein, 7 aa, Artificial Sequence
  Description of Artificial Sequence: Synthetic peptide
  XENP024235 vlCDR2
KVSNRFS

SEQ ID NO: 1501 - protein, 9 aa, Artificial Sequence
  Description of Artificial Sequence: Synthetic peptide
  XENP024235 vlCDR3
FQGSHVPNT

SEQ ID NO: 1502 - protein, 251 aa, Artificial Sequence
  Description of Artificial Sequence: Synthetic polypeptide
  XENP024236 1C11_H3.105_L3_scFv
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1503 - protein, 117 aa, Artificial Sequence
  Description of Artificial Sequence: Synthetic polypeptide
  VH of XENP024236
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1504 - protein, 114 aa, Artificial Sequence; identical to SEQ ID NO: 649
  Description of Artificial Sequence: Synthetic polypeptide
  VL of XENP024236

SEQ ID NO: 1505 - protein, 5 aa, Artificial Sequence
  Description of Artificial Sequence: Synthetic peptide
  XENP024236 vhCDR1
HYGMN

SEQ ID NO: 1506 - protein, 17 aa, Artificial Sequence
  Description of Artificial Sequence: Synthetic peptide
  XENP024236 vhCDR2
WINTYTGEPTYADGFTG

SEQ ID NO: 1507 - protein, 8 aa, Artificial Sequence
  Description of Artificial Sequence: Synthetic peptide
  XENP024236 vhCDR3
DYYGSSPY

SEQ ID NO: 1508 - protein, 16 aa, Artificial Sequence
  Description of Artificial Sequence: Synthetic peptide
  XENP024236 vlCDR1
KSSQSIVHSNGNTYLE

SEQ ID NO: 1509 - protein, 7 aa, Artificial Sequence
  Description of Artificial Sequence: Synthetic peptide
  XENP024236 vlCDR2
KVSNRFS

SEQ ID NO: 1510 - protein, 9 aa, Artificial Sequence
  Description of Artificial Sequence: Synthetic peptide
  XENP024236 vlCDR3
FQGSHVPNT

SEQ ID NO: 1511 - protein, 251 aa, Artificial Sequence
  Description of Artificial Sequence: Synthetic polypeptide
  XENP024237 1C11_H3.106_L3_scFv
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1512 - protein, 117 aa, Artificial Sequence
  Description of Artificial Sequence: Synthetic polypeptide
  VH of XENP024237
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1513 - protein, 114 aa, Artificial Sequence; identical to SEQ ID NO: 649
  Description of Artificial Sequence: Synthetic polypeptide
  VL of XENP024237

SEQ ID NO: 1514 - protein, 5 aa, Artificial Sequence
  Description of Artificial Sequence: Synthetic peptide
  XENP024237 vhCDR1
HYGMN

SEQ ID NO: 1515 - protein, 17 aa, Artificial Sequence
  Description of Artificial Sequence: Synthetic peptide
  XENP024237 vhCDR2
WINTYTGEPTYADGFTG

SEQ ID NO: 1516 - protein, 8 aa, Artificial Sequence
  Description of Artificial Sequence: Synthetic peptide
  XENP024237 vhCDR3
DYYGSSPY

SEQ ID NO: 1517 - protein, 16 aa, Artificial Sequence
  Description of Artificial Sequence: Synthetic peptide
  XENP024237 vlCDR1
KSSQSIVHSNGNTYLE

SEQ ID NO: 1518 - protein, 7 aa, Artificial Sequence
  Description of Artificial Sequence: Synthetic peptide
  XENP024237 vlCDR2
KVSNRFS

SEQ ID NO: 1519 - protein, 9 aa, Artificial Sequence
  Description of Artificial Sequence: Synthetic peptide
  XENP024237 vlCDR3
FQGSHVPNT

SEQ ID NO: 1520 - protein, 251 aa, Artificial Sequence
  Description of Artificial Sequence: Synthetic polypeptide
  XENP024238 1C11_H3.107_L3_scFv
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1521 - protein, 117 aa, Artificial Sequence
  Description of Artificial Sequence: Synthetic polypeptide
  VH of XENP024238
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1522 - protein, 114 aa, Artificial Sequence; identical to SEQ ID NO: 649
  Description of Artificial Sequence: Synthetic polypeptide
  VL of XENP024238

SEQ ID NO: 1523 - protein, 5 aa, Artificial Sequence
  Description of Artificial Sequence: Synthetic peptide
  XENP024238 vhCDR1
HYGMN

SEQ ID NO: 1524 - protein, 17 aa, Artificial Sequence
  Description of Artificial Sequence: Synthetic peptide
  XENP024238 vhCDR2
WINTYTGEPTYADGFTG

SEQ ID NO: 1525 - protein, 8 aa, Artificial Sequence
  Description of Artificial Sequence: Synthetic peptide
  XENP024238 vhCDR3
DYYGSSPY

SEQ ID NO: 1526 - protein, 16 aa, Artificial Sequence
  Description of Artificial Sequence: Synthetic peptide
  XENP024238 vlCDR1
KSSQSIVHSNGNTYLE

SEQ ID NO: 1527 - protein, 7 aa, Artificial Sequence
  Description of Artificial Sequence: Synthetic peptide
  XENP024238 vlCDR2
KVSNRFS

SEQ ID NO: 1528 - protein, 9 aa, Artificial Sequence
  Description of Artificial Sequence: Synthetic peptide
  XENP024238 vlCDR3
FQGSHVPNT

SEQ ID NO: 1529 - protein, 251 aa, Artificial Sequence
  Description of Artificial Sequence: Synthetic polypeptide
  XENP024239 1C11_H3.109_L3_scFv
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1530 - protein, 117 aa, Artificial Sequence
  Description of Artificial Sequence: Synthetic polypeptide
  VH of XENP024239
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1531 - protein, 114 aa, Artificial Sequence; identical to SEQ ID NO: 649
  Description of Artificial Sequence: Synthetic polypeptide
  VL of XENP024239

SEQ ID NO: 1532 - protein, 5 aa, Artificial Sequence
  Description of Artificial Sequence: Synthetic peptide
  XENP024239 vhCDR1
HYGMN

SEQ ID NO: 1533 - protein, 17 aa, Artificial Sequence
  Description of Artificial Sequence: Synthetic peptide
  XENP024239 vhCDR2
WINTYTGEPTYADGFTG

SEQ ID NO: 1534 - protein, 8 aa, Artificial Sequence
  Description of Artificial Sequence: Synthetic peptide
  XENP024239 vhCDR3
DYYGSSPY

SEQ ID NO: 1535 - protein, 16 aa, Artificial Sequence
  Description of Artificial Sequence: Synthetic peptide
  XENP024239 vlCDR1
KSSQSIVHSNGNTYLE

SEQ ID NO: 1536 - protein, 7 aa, Artificial Sequence
  Description of Artificial Sequence: Synthetic peptide
  XENP024239 vlCDR2
KVSNRFS

SEQ ID NO: 1537 - protein, 9 aa, Artificial Sequence
  Description of Artificial Sequence: Synthetic peptide
  XENP024239 vlCDR3
FQGSHVPNT

SEQ ID NO: 1538 - protein, 251 aa, Artificial Sequence
  Description of Artificial Sequence: Synthetic polypeptide
  XENP024240 1C11_H3.110_L3_scFv
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1539 - protein, 117 aa, Artificial Sequence
  Description of Artificial Sequence: Synthetic polypeptide
  VH of XENP024240
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1540 - protein, 114 aa, Artificial Sequence; identical to SEQ ID NO: 649
  Description of Artificial Sequence: Synthetic polypeptide
  VL of XENP024240

SEQ ID NO: 1541 - protein, 5 aa, Artificial Sequence
  Description of Artificial Sequence: Synthetic peptide
  XENP024240 vhCDR1
HYGMN

SEQ ID NO: 1542 - protein, 17 aa, Artificial Sequence
  Description of Artificial Sequence: Synthetic peptide
  XENP024240 vhCDR2
WINTYTGEPTYADGFTG

SEQ ID NO: 1543 - protein, 8 aa, Artificial Sequence
  Description of Artificial Sequence: Synthetic peptide
  XENP024240 vhCDR3
DYYGSSPY

SEQ ID NO: 1544 - protein, 16 aa, Artificial Sequence
  Description of Artificial Sequence: Synthetic peptide
  XENP024240 vlCDR1
KSSQSIVHSNGNTYLE

SEQ ID NO: 1545 - protein, 7 aa, Artificial Sequence
  Description of Artificial Sequence: Synthetic peptide
  XENP024240 vlCDR2
KVSNRFS

SEQ ID NO: 1546 - protein, 9 aa, Artificial Sequence
  Description of Artificial Sequence: Synthetic peptide
  XENP024240 vlCDR3
FQGSHVPNT

SEQ ID NO: 1547 - protein, 251 aa, Artificial Sequence
  Description of Artificial Sequence: Synthetic polypeptide
  XENP024241 1C11_H3.111_L3_scFv
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1548 - protein, 117 aa, Artificial Sequence
  Description of Artificial Sequence: Synthetic polypeptide
  VH of XENP024241
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1549 - protein, 114 aa, Artificial Sequence; identical to SEQ ID NO: 649
  Description of Artificial Sequence: Synthetic polypeptide
  VL of XENP024241

SEQ ID NO: 1550 - protein, 5 aa, Artificial Sequence
  Description of Artificial Sequence: Synthetic peptide
  XENP024241 vhCDR1
HYGMN

SEQ ID NO: 1551 - protein, 17 aa, Artificial Sequence
  Description of Artificial Sequence: Synthetic peptide
  XENP024241 vhCDR2
WINTYTGEPTYADGFTG

SEQ ID NO: 1552 - protein, 8 aa, Artificial Sequence
  Description of Artificial Sequence: Synthetic peptide
  XENP024241 vhCDR3
DYYGSSPY

SEQ ID NO: 1553 - protein, 16 aa, Artificial Sequence
  Description of Artificial Sequence: Synthetic peptide
  XENP024241 vlCDR1
KSSQSIVHSNGNTYLE

SEQ ID NO: 1554 - protein, 7 aa, Artificial Sequence
  Description of Artificial Sequence: Synthetic peptide
  XENP024241 vlCDR2
KVSNRFS

SEQ ID NO: 1555 - protein, 9 aa, Artificial Sequence
  Description of Artificial Sequence: Synthetic peptide
  XENP024241 vlCDR3
FQGSHVPNT

SEQ ID NO: 1556 - protein, 251 aa, Artificial Sequence
  Description of Artificial Sequence: Synthetic polypeptide
  XENP024242 1C11_H3.113_L3_scFv
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1557 - protein, 117 aa, Artificial Sequence
  Description of Artificial Sequence: Synthetic polypeptide
  VH of XENP024242
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1558 - protein, 114 aa, Artificial Sequence; identical to SEQ ID NO: 649
  Description of Artificial Sequence: Synthetic polypeptide
  VL of XENP024242

SEQ ID NO: 1559 - protein, 5 aa, Artificial Sequence
  Description of Artificial Sequence: Synthetic peptide
  XENP024242 vhCDR1
HYGMN

SEQ ID NO: 1560 - protein, 17 aa, Artificial Sequence
  Description of Artificial Sequence: Synthetic peptide
  XENP024242 vhCDR2
WINTYTGEPTYADGFTG

SEQ ID NO: 1561 - protein, 8 aa, Artificial Sequence
  Description of Artificial Sequence: Synthetic peptide
  XENP024242 vhCDR3
DYYGSSPY

SEQ ID NO: 1562 - protein, 16 aa, Artificial Sequence
  Description of Artificial Sequence: Synthetic peptide
  XENP024242 vlCDR1
KSSQSIVHSNGNTYLE

SEQ ID NO: 1563 - protein, 7 aa, Artificial Sequence
  Description of Artificial Sequence: Synthetic peptide
  XENP024242 vlCDR2
KVSNRFS

SEQ ID NO: 1564 - protein, 9 aa, Artificial Sequence
  Description of Artificial Sequence: Synthetic peptide
  XENP024242 vlCDR3
FQGSHVPNT

SEQ ID NO: 1565 - protein, 251 aa, Artificial Sequence
  Description of Artificial Sequence: Synthetic polypeptide
  XENP024243 1C11_H3.114_L3_scFv
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1566 - protein, 117 aa, Artificial Sequence
  Description of Artificial Sequence: Synthetic polypeptide
  VH of XENP024243
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1567 - protein, 114 aa, Artificial Sequence; identical to SEQ ID NO: 649
  Description of Artificial Sequence: Synthetic polypeptide
  VL of XENP024243

SEQ ID NO: 1568 - protein, 5 aa, Artificial Sequence
  Description of Artificial Sequence: Synthetic peptide
  XENP024243 vhCDR1
HYGMN

SEQ ID NO: 1569 - protein, 17 aa, Artificial Sequence
  Description of Artificial Sequence: Synthetic peptide
  XENP024243 vhCDR2
WINTYTGEPTYADGFTG

SEQ ID NO: 1570 - protein, 8 aa, Artificial Sequence
  Description of Artificial Sequence: Synthetic peptide
  XENP024243 vhCDR3
DYYGSSPY

SEQ ID NO: 1571 - protein, 16 aa, Artificial Sequence
  Description of Artificial Sequence: Synthetic peptide
  XENP024243 vlCDR1
KSSQSIVHSNGNTYLE

SEQ ID NO: 1572 - protein, 7 aa, Artificial Sequence
  Description of Artificial Sequence: Synthetic peptide
  XENP024243 vlCDR2
KVSNRFS

SEQ ID NO: 1573 - protein, 9 aa, Artificial Sequence
  Description of Artificial Sequence: Synthetic peptide
  XENP024243 vlCDR3
FQGSHVPNT

SEQ ID NO: 1574 - protein, 251 aa, Artificial Sequence
  Description of Artificial Sequence: Synthetic polypeptide
  XENP024244 1C11_H3.115_L3_scFv
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1575 - protein, 117 aa, Artificial Sequence
  Description of Artificial Sequence: Synthetic polypeptide
  VH of XENP024244
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1576 - protein, 114 aa, Artificial Sequence; identical to SEQ ID NO: 649
  Description of Artificial Sequence: Synthetic polypeptide
  VL of XENP024244

SEQ ID NO: 1577 - protein, 5 aa, Artificial Sequence
  Description of Artificial Sequence: Synthetic peptide
  XENP024244 vhCDR1
HYGMN

SEQ ID NO: 1578 - protein, 17 aa, Artificial Sequence
  Description of Artificial Sequence: Synthetic peptide
  XENP024244 vhCDR2
WINTYTGEPTYADGFTG

SEQ ID NO: 1579 - protein, 8 aa, Artificial Sequence
  Description of Artificial Sequence: Synthetic peptide
  XENP024244 vhCDR3
DYYGSSPY

SEQ ID NO: 1580 - protein, 16 aa, Artificial Sequence
  Description of Artificial Sequence: Synthetic peptide
  XENP024244 vlCDR1
KSSQSIVHSNGNTYLE

SEQ ID NO: 1581 - protein, 7 aa, Artificial Sequence
  Description of Artificial Sequence: Synthetic peptide
  XENP024244 vlCDR2
KVSNRFS

SEQ ID NO: 1582 - protein, 9 aa, Artificial Sequence
  Description of Artificial Sequence: Synthetic peptide
  XENP024244 vlCDR3
FQGSHVPNT

SEQ ID NO: 1583 - protein, 251 aa, Artificial Sequence
  Description of Artificial Sequence: Synthetic polypeptide
  XENP024245 1C11_H3.116_L3_scFv
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1584 - protein, 117 aa, Artificial Sequence
  Description of Artificial Sequence: Synthetic polypeptide
  VH of XENP024245
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1585 - protein, 114 aa, Artificial Sequence; identical to SEQ ID NO: 649
  Description of Artificial Sequence: Synthetic polypeptide
  VL of XENP024245

SEQ ID NO: 1586 - protein, 5 aa, Artificial Sequence
  Description of Artificial Sequence: Synthetic peptide
  XENP024245 vhCDR1
HYGMN

SEQ ID NO: 1587 - protein, 17 aa, Artificial Sequence
  Description of Artificial Sequence: Synthetic peptide
  XENP024245 vhCDR2
WINTYTGEPTYADGFTG

SEQ ID NO: 1588 - protein, 8 aa, Artificial Sequence
  Description of Artificial Sequence: Synthetic peptide
  XENP024245 vhCDR3
DYYGSSPY

SEQ ID NO: 1589 - protein, 16 aa, Artificial Sequence
  Description of Artificial Sequence: Synthetic peptide
  XENP024245 vlCDR1
KSSQSIVHSNGNTYLE

SEQ ID NO: 1590 - protein, 7 aa, Artificial Sequence
  Description of Artificial Sequence: Synthetic peptide
  XENP024245 vlCDR2
KVSNRFS

SEQ ID NO: 1591 - protein, 9 aa, Artificial Sequence
  Description of Artificial Sequence: Synthetic peptide
  XENP024245 vlCDR3
FQGSHVPNT

SEQ ID NO: 1592 - protein, 251 aa, Artificial Sequence
  Description of Artificial Sequence: Synthetic polypeptide
  XENP024246 1C11_H3.117_L3_scFv
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1593 - protein, 117 aa, Artificial Sequence
  Description of Artificial Sequence: Synthetic polypeptide
  VH of XENP024246
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1594 - protein, 114 aa, Artificial Sequence; identical to SEQ ID NO: 649
  Description of Artificial Sequence: Synthetic polypeptide
  VL of XENP024246

SEQ ID NO: 1595 - protein, 5 aa, Artificial Sequence
  Description of Artificial Sequence: Synthetic peptide
  XENP024246 vhCDR1
HYGMN

SEQ ID NO: 1596 - protein, 17 aa, Artificial Sequence
  Description of Artificial Sequence: Synthetic peptide
  XENP024246 vhCDR2
WINTYTGEPTYADGFTG

SEQ ID NO: 1597 - protein, 8 aa, Artificial Sequence
  Description of Artificial Sequence: Synthetic peptide
  XENP024246 vhCDR3
DYYGSSPY

SEQ ID NO: 1598 - protein, 16 aa, Artificial Sequence
  Description of Artificial Sequence: Synthetic peptide
  XENP024246 vlCDR1
KSSQSIVHSNGNTYLE

SEQ ID NO: 1599 - protein, 7 aa, Artificial Sequence
  Description of Artificial Sequence: Synthetic peptide
  XENP024246 vlCDR2
KVSNRFS

SEQ ID NO: 1600 - protein, 9 aa, Artificial Sequence
  Description of Artificial Sequence: Synthetic peptide
  XENP024246 vlCDR3
FQGSHVPNT

SEQ ID NO: 1601 - protein, 251 aa, Artificial Sequence
  Description of Artificial Sequence: Synthetic polypeptide
  XENP024247 1C11_H3.120_L3_scFv
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1602 - protein, 117 aa, Artificial Sequence
  Description of Artificial Sequence: Synthetic polypeptide
  VH of XENP024247
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1603 - protein, 114 aa, Artificial Sequence; identical to SEQ ID NO: 649
  Description of Artificial Sequence: Synthetic polypeptide
  VL of XENP024247

SEQ ID NO: 1604 - protein, 5 aa, Artificial Sequence
  Description of Artificial Sequence: Synthetic peptide
  XENP024247 vhCDR1
HYGIN

SEQ ID NO: 1605 - protein, 17 aa, Artificial Sequence
  Description of Artificial Sequence: Synthetic peptide
  XENP024247 vhCDR2
WINTYTGEPTYADGFTG

SEQ ID NO: 1606 - protein, 8 aa, Artificial Sequence
  Description of Artificial Sequence: Synthetic peptide
  XENP024247 vhCDR3
DYYGSSPY

SEQ ID NO: 1607 - protein, 16 aa, Artificial Sequence
  Description of Artificial Sequence: Synthetic peptide
  XENP024247 vlCDR1
KSSQSIVHSNGNTYLE

SEQ ID NO: 1608 - protein, 7 aa, Artificial Sequence
  Description of Artificial Sequence: Synthetic peptide
  XENP024247 vlCDR2
KVSNRFS

SEQ ID NO: 1609 - protein, 9 aa, Artificial Sequence
  Description of Artificial Sequence: Synthetic peptide
  XENP024247 vlCDR3
FQGSHVPNT

SEQ ID NO: 1610 - protein, 251 aa, Artificial Sequence
  Description of Artificial Sequence: Synthetic polypeptide
  XENP024248 1C11_H3.121_L3_scFv
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1611 - protein, 117 aa, Artificial Sequence
  Description of Artificial Sequence: Synthetic polypeptide
  VH of XENP024248
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 1612 - protein, 114 aa, Artificial Sequence; identical to SEQ ID NO: 649
  Description of Artificial Sequence: Synthetic polypeptide
  VL of XENP024248

SEQ ID NO: 1613 - protein, 5 aa, Artificial Sequence
  Description of Artificial Sequence: Synthetic peptide
  XENP024248 vhCDR1
HYGVN

SEQ ID NO: 1614 - protein, 17 aa, Artificial Sequence
  Description of Artificial Sequence: Synthetic peptide
  XENP024248 vhCDR2
WINTYTGEPTYADGFTG

SEQ ID NO: 1615 - protein, 8 aa, Artificial Sequence
  Description of Artificial Sequence: Synthetic peptide
  XENP024248 vhCDR3
DYYGSSPY

SEQ ID NO: 1616 - protein, 16 aa, Artificial Sequence
  Description of Artificial Sequence: Synthetic peptide
  XENP024248 vlCDR1
KSSQSIVHSNGNTYLE

SEQ ID NO: 1617 - protein, 7 aa, Artificial Sequence
  Description of Artificial Sequence: Synthetic peptide
  XENP024248 vlCDR2
KVSNRFS

SEQ ID NO: 1618 - protein, 9 aa, Artificial Sequence
  Description of Artificial Sequence: Synthetic peptide
  XENP024248 vlCDR3
FQGSHVPNT

SEQ ID NO: 1619 - protein, 251 aa, Artificial Sequence
  Description of Artificial Sequence: Synthetic polypeptide
  XENP024249 1C11_H3.123_L3_scFv
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1620 - protein, 117 aa, Artificial Sequence
  Description of Artificial Sequence: Synthetic polypeptide
  VH of XENP024249
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSS

SEQ ID NO: 1621 - protein, 114 aa, Artificial Sequence; identical to SEQ ID NO: 649
  Description of Artificial Sequence: Synthetic polypeptide
  VL of XENP024249

SEQ ID NO: 1622 - protein, 5 aa, Artificial Sequence
  Description of Artificial Sequence: Synthetic peptide
  XENP024249 vhCDR1
HYGMN

SEQ ID NO: 1623 - protein, 17 aa, Artificial Sequence
  Description of Artificial Sequence: Synthetic peptide
  XENP024249 vhCDR2
WINTYTGEPTYADGFTG

SEQ ID NO: 1624 - protein, 8 aa, Artificial Sequence
  Description of Artificial Sequence: Synthetic peptide
  XENP024249 vhCDR3
DYYGSSPY

SEQ ID NO: 1625 - protein, 16 aa, Artificial Sequence
  Description of Artificial Sequence: Synthetic peptide
  XENP024249 vlCDR1
KSSQSIVHSNGNTYLE

SEQ ID NO: 1626 - protein, 7 aa, Artificial Sequence
  Description of Artificial Sequence: Synthetic peptide
  XENP024249 vlCDR2
KVSNRFS

SEQ ID NO: 1627 - protein, 9 aa, Artificial Sequence
  Description of Artificial Sequence: Synthetic peptide
  XENP024249 vlCDR3
FQGSHVPNT

SEQ ID NO: 1628 - protein, 251 aa, Artificial Sequence
  Description of Artificial Sequence: Synthetic polypeptide
  XENP024250 1C11_H3.125_L3_scFv
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1629 - protein, 117 aa, Artificial Sequence
  Description of Artificial Sequence: Synthetic polypeptide
  VH of XENP024250
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSS

SEQ ID NO: 1630 - protein, 114 aa, Artificial Sequence; identical to SEQ ID NO: 649
  Description of Artificial Sequence: Synthetic polypeptide
  VL of XENP024250

SEQ ID NO: 1631 - protein, 5 aa, Artificial Sequence
  Description of Artificial Sequence: Synthetic peptide
  XENP024250 vhCDR1
HYGMN

SEQ ID NO: 1632 - protein, 17 aa, Artificial Sequence
  Description of Artificial Sequence: Synthetic peptide
  XENP024250 vhCDR2
WINTYTGEPTYADGFTG

SEQ ID NO: 1633 - protein, 8 aa, Artificial Sequence
  Description of Artificial Sequence: Synthetic peptide
  XENP024250 vhCDR3
DYYGSSPY

SEQ ID NO: 1634 - protein, 16 aa, Artificial Sequence
  Description of Artificial Sequence: Synthetic peptide
  XENP024250 vlCDR1
KSSQSIVHSNGNTYLE

SEQ ID NO: 1635 - protein, 7 aa, Artificial Sequence
  Description of Artificial Sequence: Synthetic peptide
  XENP024250 vlCDR2
KVSNRFS

SEQ ID NO: 1636 - protein, 9 aa, Artificial Sequence
  Description of Artificial Sequence: Synthetic peptide
  XENP024250 vlCDR3
FQGSHVPNT

SEQ ID NO: 1637 - protein, 251 aa, Artificial Sequence
  Description of Artificial Sequence: Synthetic polypeptide
  XENP024251 1C11_H3.126_L3_scFv
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1638 - protein, 117 aa, Artificial Sequence
  Description of Artificial Sequence: Synthetic polypeptide
  VH of XENP024251
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSS

SEQ ID NO: 1639 - protein, 114 aa, Artificial Sequence; identical to SEQ ID NO: 649
  Description of Artificial Sequence: Synthetic polypeptide
  VL of XENP024251

SEQ ID NO: 1640 - protein, 5 aa, Artificial Sequence
  Description of Artificial Sequence: Synthetic peptide
  XENP024251 vhCDR1
HYGMN

SEQ ID NO: 1641 - protein, 17 aa, Artificial Sequence
  Description of Artificial Sequence: Synthetic peptide
  XENP024251 vhCDR2
WINTYTGEPTYADGFTG

SEQ ID NO: 1642 - protein, 8 aa, Artificial Sequence
  Description of Artificial Sequence: Synthetic peptide
  XENP024251 vhCDR3
DYYGSSPY

SEQ ID NO: 1643 - protein, 16 aa, Artificial Sequence
  Description of Artificial Sequence: Synthetic peptide
  XENP024251 vlCDR1
KSSQSIVHSNGNTYLE

SEQ ID NO: 1644 - protein, 7 aa, Artificial Sequence
  Description of Artificial Sequence: Synthetic peptide
  XENP024251 vlCDR2
KVSNRFS

SEQ ID NO: 1645 - protein, 9 aa, Artificial Sequence
  Description of Artificial Sequence: Synthetic peptide
  XENP024251 vlCDR3
FQGSHVPNT

SEQ ID NO: 1646 - protein, 251 aa, Artificial Sequence
  Description of Artificial Sequence: Synthetic polypeptide
  XENP024252 1C11_H3.127_L3_scFv
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1647 - protein, 117 aa, Artificial Sequence
  Description of Artificial Sequence: Synthetic polypeptide
  VH of XENP024252
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSS

SEQ ID NO: 1648 - protein, 114 aa, Artificial Sequence; identical to SEQ ID NO: 649
  Description of Artificial Sequence: Synthetic polypeptide
  VL of XENP024252

SEQ ID NO: 1649 - protein, 5 aa, Artificial Sequence
  Description of Artificial Sequence: Synthetic peptide
  XENP024252 vhCDR1
HYGMN

SEQ ID NO: 1650 - protein, 17 aa, Artificial Sequence
  Description of Artificial Sequence: Synthetic peptide
  XENP024252 vhCDR2
WINTYTGEPTYADGFTG

SEQ ID NO: 1651 - protein, 8 aa, Artificial Sequence
  Description of Artificial Sequence: Synthetic peptide
  XENP024252 vhCDR3
DYYGSSPY

SEQ ID NO: 1652 - protein, 16 aa, Artificial Sequence
  Description of Artificial Sequence: Synthetic peptide
  XENP024252 vlCDR1
KSSQSIVHSNGNTYLE

SEQ ID NO: 1653 - protein, 7 aa, Artificial Sequence
  Description of Artificial Sequence: Synthetic peptide
  XENP024252 vlCDR2
KVSNRFS

SEQ ID NO: 1654 - protein, 9 aa, Artificial Sequence
  Description of Artificial Sequence: Synthetic peptide
  XENP024252 vlCDR3
FQGSHVPNT

SEQ ID NO: 1655 - protein, 251 aa, Artificial Sequence
  Description of Artificial Sequence: Synthetic polypeptide
  XENP024253 1C11_H3.128_L3_scFv
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1656 - protein, 117 aa, Artificial Sequence
  Description of Artificial Sequence: Synthetic polypeptide
  VH of XENP024253
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSS

SEQ ID NO: 1657 - protein, 114 aa, Artificial Sequence; identical to SEQ ID NO: 649
  Description of Artificial Sequence: Synthetic polypeptide
  VL of XENP024253

SEQ ID NO: 1658 - protein, 5 aa, Artificial Sequence
  Description of Artificial Sequence: Synthetic peptide
  XENP024253 vhCDR1
HYGMN

SEQ ID NO: 1659 - protein, 17 aa, Artificial Sequence
  Description of Artificial Sequence: Synthetic peptide
  XENP024253 vhCDR2
WINTYTGEPTYADGFTG

SEQ ID NO: 1660 - protein, 8 aa, Artificial Sequence
  Description of Artificial Sequence: Synthetic peptide
  XENP024253 vhCDR3
DYYGSSPY

SEQ ID NO: 1661 - protein, 16 aa, Artificial Sequence
  Description of Artificial Sequence: Synthetic peptide
  XENP024253 vlCDR1
KSSQSIVHSNGNTYLE

SEQ ID NO: 1662 - protein, 7 aa, Artificial Sequence
  Description of Artificial Sequence: Synthetic peptide
  XENP024253 vlCDR2
KVSNRFS

SEQ ID NO: 1663 - protein, 9 aa, Artificial Sequence
  Description of Artificial Sequence: Synthetic peptide
  XENP024253 vlCDR3
FQGSHVPNT

SEQ ID NO: 1664 - protein, 251 aa, Artificial Sequence
  Description of Artificial Sequence: Synthetic polypeptide
  XENP024254 1C11_H3.129_L3_scFv
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1665 - protein, 117 aa, Artificial Sequence
  Description of Artificial Sequence: Synthetic polypeptide
  VH of XENP024254
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSS

SEQ ID NO: 1666 - protein, 114 aa, Artificial Sequence; identical to SEQ ID NO: 649
  Description of Artificial Sequence: Synthetic polypeptide
  VL of XENP024254

SEQ ID NO: 1667 - protein, 5 aa, Artificial Sequence
  Description of Artificial Sequence: Synthetic peptide
  XENP024254 vhCDR1
HYGMN

SEQ ID NO: 1668 - protein, 17 aa, Artificial Sequence
  Description of Artificial Sequence: Synthetic peptide
  XENP024254 vhCDR2
WINTYTGEPTYADGFTG

SEQ ID NO: 1669 - protein, 8 aa, Artificial Sequence
  Description of Artificial Sequence: Synthetic peptide
  XENP024254 vhCDR3
DYYGSSPY

SEQ ID NO: 1670 - protein, 16 aa, Artificial Sequence
  Description of Artificial Sequence: Synthetic peptide
  XENP024254 vlCDR1
KSSQSIVHSNGNTYLE

SEQ ID NO: 1671 - protein, 7 aa, Artificial Sequence
  Description of Artificial Sequence: Synthetic peptide
  XENP024254 vlCDR2
KVSNRFS

SEQ ID NO: 1672 - protein, 9 aa, Artificial Sequence
  Description of Artificial Sequence: Synthetic peptide
  XENP024254 vlCDR3
FQGSHVPNT

SEQ ID NO: 1673 - protein, 251 aa, Artificial Sequence
  Description of Artificial Sequence: Synthetic polypeptide
  XENP024255 1C11_H3.130_L3_scFv
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1674 - protein, 117 aa, Artificial Sequence
  Description of Artificial Sequence: Synthetic polypeptide
  VH of XENP024255
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSS

SEQ ID NO: 1675 - protein, 114 aa, Artificial Sequence; identical to SEQ ID NO: 649
  Description of Artificial Sequence: Synthetic polypeptide
  VL of XENP024255

SEQ ID NO: 1676 - protein, 5 aa, Artificial Sequence
  Description of Artificial Sequence: Synthetic peptide
  XENP024255 vhCDR1
HYGMN

SEQ ID NO: 1677 - protein, 17 aa, Artificial Sequence
  Description of Artificial Sequence: Synthetic peptide
  XENP024255 vhCDR2
WINTYTGEPTYADGFTG

SEQ ID NO: 1678 - protein, 8 aa, Artificial Sequence
  Description of Artificial Sequence: Synthetic peptide
  XENP024255 vhCDR3
DYYGSSPY

SEQ ID NO: 1679 - protein, 16 aa, Artificial Sequence
  Description of Artificial Sequence: Synthetic peptide
  XENP024255 vlCDR1
KSSQSIVHSNGNTYLE

SEQ ID NO: 1680 - protein, 7 aa, Artificial Sequence
  Description of Artificial Sequence: Synthetic peptide
  XENP024255 vlCDR2
KVSNRFS

SEQ ID NO: 1681 - protein, 9 aa, Artificial Sequence
  Description of Artificial Sequence: Synthetic peptide
  XENP024255 vlCDR3
FQGSHVPNT

SEQ ID NO: 1682 - protein, 251 aa, Artificial Sequence
  Description of Artificial Sequence: Synthetic polypeptide
  XENP024256 1C11_H3.134_L3_scFv
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1683 - protein, 117 aa, Artificial Sequence
  Description of Artificial Sequence: Synthetic polypeptide
  VH of XENP024256
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSS

SEQ ID NO: 1684 - protein, 114 aa, Artificial Sequence; identical to SEQ ID NO: 649
  Description of Artificial Sequence: Synthetic polypeptide
  VL of XENP024256

SEQ ID NO: 1685 - protein, 5 aa, Artificial Sequence
  Description of Artificial Sequence: Synthetic peptide
  XENP024256 vhCDR1
HYGMN

SEQ ID NO: 1686 - protein, 17 aa, Artificial Sequence
  Description of Artificial Sequence: Synthetic peptide
  XENP024256 vhCDR2
WINTKTGEPTYADGFTG

SEQ ID NO: 1687 - protein, 8 aa, Artificial Sequence
  Description of Artificial Sequence: Synthetic peptide
  XENP024256 vhCDR3
DYYGSSPY

SEQ ID NO: 1688 - protein, 16 aa, Artificial Sequence
  Description of Artificial Sequence: Synthetic peptide
  XENP024256 vlCDR1
KSSQSIVHSNGNTYLE

SEQ ID NO: 1689 - protein, 7 aa, Artificial Sequence
  Description of Artificial Sequence: Synthetic peptide
  XENP024256 vlCDR2
KVSNRFS

SEQ ID NO: 1690 - protein, 9 aa, Artificial Sequence
  Description of Artificial Sequence: Synthetic peptide
  XENP024256 vlCDR3
FQGSHVPNT

SEQ ID NO: 1691 - protein, 251 aa, Artificial Sequence
  Description of Artificial Sequence: Synthetic polypeptide
  XENP024257 1C11_H3.135_L3_scFv
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1692 - protein, 117 aa, Artificial Sequence
  Description of Artificial Sequence: Synthetic polypeptide
  VH of XENP024257
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSS

SEQ ID NO: 1693 - protein, 114 aa, Artificial Sequence; identical to SEQ ID NO: 649
  Description of Artificial Sequence: Synthetic polypeptide
  VL of XENP024257

SEQ ID NO: 1694 - protein, 5 aa, Artificial Sequence
  Description of Artificial Sequence: Synthetic peptide
  XENP024257 vhCDR1
HYGMN

SEQ ID NO: 1695 - protein, 17 aa, Artificial Sequence
  Description of Artificial Sequence: Synthetic peptide
  XENP024257 vhCDR2
WINTYTSEPTYADGFTG

SEQ ID NO: 1696 - protein, 8 aa, Artificial Sequence
  Description of Artificial Sequence: Synthetic peptide
  XENP024257 vhCDR3
DYYGSSPY

SEQ ID NO: 1697 - protein, 16 aa, Artificial Sequence
  Description of Artificial Sequence: Synthetic peptide
  XENP024257 vlCDR1
KSSQSIVHSNGNTYLE

SEQ ID NO: 1698 - protein, 7 aa, Artificial Sequence
  Description of Artificial Sequence: Synthetic peptide
  XENP024257 vlCDR2
KVSNRFS

SEQ ID NO: 1699 - protein, 9 aa, Artificial Sequence
  Description of Artificial Sequence: Synthetic peptide
  XENP024257 vlCDR3
FQGSHVPNT

SEQ ID NO: 1700 - protein, 251 aa, Artificial Sequence
  Description of Artificial Sequence: Synthetic polypeptide
  XENP024258 1C11_H3.136_L3_scFv
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1701 - protein, 117 aa, Artificial Sequence
  Description of Artificial Sequence: Synthetic polypeptide
  VH of XENP024258
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSS

SEQ ID NO: 1702 - protein, 114 aa, Artificial Sequence; identical to SEQ ID NO: 649
  Description of Artificial Sequence: Synthetic polypeptide
  VL of XENP024258

SEQ ID NO: 1703 - protein, 5 aa, Artificial Sequence
  Description of Artificial Sequence: Synthetic peptide
  XENP024258 vhCDR1
HYGMN

SEQ ID NO: 1704 - protein, 17 aa, Artificial Sequence
  Description of Artificial Sequence: Synthetic peptide
  XENP024258 vhCDR2
WINTYTGSPTYADGFTG

SEQ ID NO: 1705 - protein, 8 aa, Artificial Sequence
  Description of Artificial Sequence: Synthetic peptide
  XENP024258 vhCDR3
DYYGSSPY

SEQ ID NO: 1706 - protein, 16 aa, Artificial Sequence
  Description of Artificial Sequence: Synthetic peptide
  XENP024258 vlCDR1
KSSQSIVHSNGNTYLE

SEQ ID NO: 1707 - protein, 7 aa, Artificial Sequence
  Description of Artificial Sequence: Synthetic peptide
  XENP024258 vlCDR2
KVSNRFS

SEQ ID NO: 1708 - protein, 9 aa, Artificial Sequence
  Description of Artificial Sequence: Synthetic peptide
  XENP024258 vlCDR3
FQGSHVPNT

SEQ ID NO: 1709 - protein, 251 aa, Artificial Sequence
  Description of Artificial Sequence: Synthetic polypeptide
  XENP024259 1C11_H3.137_L3_scFv
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1710 - protein, 117 aa, Artificial Sequence
  Description of Artificial Sequence: Synthetic polypeptide
  VH of XENP024259
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSS

SEQ ID NO: 1711 - protein, 114 aa, Artificial Sequence; identical to SEQ ID NO: 649
  Description of Artificial Sequence: Synthetic polypeptide
  VL of XENP024259

SEQ ID NO: 1712 - protein, 5 aa, Artificial Sequence
  Description of Artificial Sequence: Synthetic peptide
  XENP024259 vhCDR1
HYGMN

SEQ ID NO: 1713 - protein, 17 aa, Artificial Sequence
  Description of Artificial Sequence: Synthetic peptide
  XENP024259 vhCDR2
WINTYTGNPTYADGFTG

SEQ ID NO: 1714 - protein, 8 aa, Artificial Sequence
  Description of Artificial Sequence: Synthetic peptide
  XENP024259 vhCDR3
DYYGSSPY

SEQ ID NO: 1715 - protein, 16 aa, Artificial Sequence
  Description of Artificial Sequence: Synthetic peptide
  XENP024259 vlCDR1
KSSQSIVHSNGNTYLE

SEQ ID NO: 1716 - protein, 7 aa, Artificial Sequence
  Description of Artificial Sequence: Synthetic peptide
  XENP024259 vlCDR2
KVSNRFS

SEQ ID NO: 1717 - protein, 9 aa, Artificial Sequence
  Description of Artificial Sequence: Synthetic peptide
  XENP024259 vlCDR3
FQGSHVPNT

SEQ ID NO: 1718 - protein, 251 aa, Artificial Sequence
  Description of Artificial Sequence: Synthetic polypeptide
  XENP024260 1C11_H3.138_L3_scFv
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1719 - protein, 117 aa, Artificial Sequence
  Description of Artificial Sequence: Synthetic polypeptide
  VH of XENP024260
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSS

SEQ ID NO: 1720 - protein, 114 aa, Artificial Sequence; identical to SEQ ID NO: 649
  Description of Artificial Sequence: Synthetic polypeptide
  VL of XENP024260

SEQ ID NO: 1721 - protein, 5 aa, Artificial Sequence
  Description of Artificial Sequence: Synthetic peptide
  XENP024260 vhCDR1
HYGMN

SEQ ID NO: 1722 - protein, 17 aa, Artificial Sequence
  Description of Artificial Sequence: Synthetic peptide
  XENP024260 vhCDR2
WINTYTGDPTYADGFTG

SEQ ID NO: 1723 - protein, 8 aa, Artificial Sequence
  Description of Artificial Sequence: Synthetic peptide
  XENP024260 vhCDR3
DYYGSSPY

SEQ ID NO: 1724 - protein, 16 aa, Artificial Sequence
  Description of Artificial Sequence: Synthetic peptide
  XENP024260 vlCDR1
KSSQSIVHSNGNTYLE

SEQ ID NO: 1725 - protein, 7 aa, Artificial Sequence
  Description of Artificial Sequence: Synthetic peptide
  XENP024260 vlCDR2
KVSNRFS

SEQ ID NO: 1726 - protein, 9 aa, Artificial Sequence
  Description of Artificial Sequence: Synthetic peptide
  XENP024260 vlCDR3
FQGSHVPNT

SEQ ID NO: 1727 - protein, 251 aa, Artificial Sequence
  Description of Artificial Sequence: Synthetic polypeptide
  XENP024261 1C11_H3.139_L3_scFv
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1728 - protein, 117 aa, Artificial Sequence
  Description of Artificial Sequence: Synthetic polypeptide
  VH of XENP024261
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSS

SEQ ID NO: 1729 - protein, 114 aa, Artificial Sequence; identical to SEQ ID NO: 649
  Description of Artificial Sequence: Synthetic polypeptide
  VL of XENP024261

SEQ ID NO: 1730 - protein, 5 aa, Artificial Sequence
  Description of Artificial Sequence: Synthetic peptide
  XENP024261 vhCDR1
HYGMN

SEQ ID NO: 1731 - protein, 17 aa, Artificial Sequence
  Description of Artificial Sequence: Synthetic peptide
  XENP024261 vhCDR2
WINTYTGTPTYADGFTG

SEQ ID NO: 1732 - protein, 8 aa, Artificial Sequence
  Description of Artificial Sequence: Synthetic peptide
  XENP024261 vhCDR3
DYYGSSPY

SEQ ID NO: 1733 - protein, 16 aa, Artificial Sequence
  Description of Artificial Sequence: Synthetic peptide
  XENP024261 vlCDR1
KSSQSIVHSNGNTYLE

SEQ ID NO: 1734 - protein, 7 aa, Artificial Sequence
  Description of Artificial Sequence: Synthetic peptide
  XENP024261 vlCDR2
KVSNRFS

SEQ ID NO: 1735 - protein, 9 aa, Artificial Sequence
  Description of Artificial Sequence: Synthetic peptide
  XENP024261 vlCDR3
FQGSHVPNT

SEQ ID NO: 1736 - protein, 251 aa, Artificial Sequence
  Description of Artificial Sequence: Synthetic polypeptide
  XENP024262 1C11_H3.140_L3_scFv
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1737 - protein, 117 aa, Artificial Sequence
  Description of Artificial Sequence: Synthetic polypeptide
  VH of XENP024262
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSS

SEQ ID NO: 1738 - protein, 114 aa, Artificial Sequence; identical to SEQ ID NO: 649
  Description of Artificial Sequence: Synthetic polypeptide
  VL of XENP024262

SEQ ID NO: 1739 - protein, 5 aa, Artificial Sequence
  Description of Artificial Sequence: Synthetic peptide
  XENP024262 vhCDR1
HYGMN

SEQ ID NO: 1740 - protein, 17 aa, Artificial Sequence
  Description of Artificial Sequence: Synthetic peptide
  XENP024262 vhCDR2
WINTYTGYPTYADGFTG

SEQ ID NO: 1741 - protein, 8 aa, Artificial Sequence
  Description of Artificial Sequence: Synthetic peptide
  XENP024262 vhCDR3
DYYGSSPY

SEQ ID NO: 1742 - protein, 16 aa, Artificial Sequence
  Description of Artificial Sequence: Synthetic peptide
  XENP024262 vlCDR1
KSSQSIVHSNGNTYLE

SEQ ID NO: 1743 - protein, 7 aa, Artificial Sequence
  Description of Artificial Sequence: Synthetic peptide
  XENP024262 vlCDR2
KVSNRFS

SEQ ID NO: 1744 - protein, 9 aa, Artificial Sequence
  Description of Artificial Sequence: Synthetic peptide
  XENP024262 vlCDR3
FQGSHVPNT

SEQ ID NO: 1745 - protein, 251 aa, Artificial Sequence
  Description of Artificial Sequence: Synthetic polypeptide
  XENP024263 1C11_H3.143_L3_scFv
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1746 - protein, 117 aa, Artificial Sequence
  Description of Artificial Sequence: Synthetic polypeptide
  VH of XENP024263
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSS

SEQ ID NO: 1747 - protein, 114 aa, Artificial Sequence; identical to SEQ ID NO: 649
  Description of Artificial Sequence: Synthetic polypeptide
  VL of XENP024263

SEQ ID NO: 1748 - protein, 5 aa, Artificial Sequence
  Description of Artificial Sequence: Synthetic peptide
  XENP024263 vhCDR1
HYGMN

SEQ ID NO: 1749 - protein, 17 aa, Artificial Sequence
  Description of Artificial Sequence: Synthetic peptide
  XENP024263 vhCDR2
WINTYTGEPYYADGFTG

SEQ ID NO: 1750 - protein, 8 aa, Artificial Sequence
  Description of Artificial Sequence: Synthetic peptide
  XENP024263 vhCDR3
DYYGSSPY

SEQ ID NO: 1751 - protein, 16 aa, Artificial Sequence
  Description of Artificial Sequence: Synthetic peptide
  XENP024263 vlCDR1
KSSQSIVHSNGNTYLE

SEQ ID NO: 1752 - protein, 7 aa, Artificial Sequence
  Description of Artificial Sequence: Synthetic peptide
  XENP024263 vlCDR2
KVSNRFS

SEQ ID NO: 1753 - protein, 9 aa, Artificial Sequence
  Description of Artificial Sequence: Synthetic peptide
  XENP024263 vlCDR3
FQGSHVPNT

SEQ ID NO: 1754 - protein, 251 aa, Artificial Sequence
  Description of Artificial Sequence: Synthetic polypeptide
  XENP024264 1C11_H3.144_L3_scFv
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1755 - protein, 117 aa, Artificial Sequence
  Description of Artificial Sequence: Synthetic polypeptide
  VH of XENP024264
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSS

SEQ ID NO: 1756 - protein, 114 aa, Artificial Sequence; identical to SEQ ID NO: 649
  Description of Artificial Sequence: Synthetic polypeptide
  VL of XENP024264

SEQ ID NO: 1757 - protein, 5 aa, Artificial Sequence
  Description of Artificial Sequence: Synthetic peptide
  XENP024264 vhCDR1
HYGMN

SEQ ID NO: 1758 - protein, 17 aa, Artificial Sequence
  Description of Artificial Sequence: Synthetic peptide
  XENP024264 vhCDR2
WINTYTGEPNYADGFTG

SEQ ID NO: 1759 - protein, 8 aa, Artificial Sequence
  Description of Artificial Sequence: Synthetic peptide
  XENP024264 vhCDR3
DYYGSSPY

SEQ ID NO: 1760 - protein, 16 aa, Artificial Sequence
  Description of Artificial Sequence: Synthetic peptide
  XENP024264 vlCDR1
KSSQSIVHSNGNTYLE

SEQ ID NO: 1761 - protein, 7 aa, Artificial Sequence
  Description of Artificial Sequence: Synthetic peptide
  XENP024264 vlCDR2
KVSNRFS

SEQ ID NO: 1762 - protein, 9 aa, Artificial Sequence
  Description of Artificial Sequence: Synthetic peptide
  XENP024264 vlCDR3
FQGSHVPNT

SEQ ID NO: 1763 - protein, 251 aa, Artificial Sequence
  Description of Artificial Sequence: Synthetic polypeptide
  XENP024265 1C11_H3.145_L3_scFv
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1764 - protein, 117 aa, Artificial Sequence
  Description of Artificial Sequence: Synthetic polypeptide
  VH of XENP024265
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSS

SEQ ID NO: 1765 - protein, 114 aa, Artificial Sequence; identical to SEQ ID NO: 649
  Description of Artificial Sequence: Synthetic polypeptide
  VL of XENP024265

SEQ ID NO: 1766 - protein, 5 aa, Artificial Sequence
  Description of Artificial Sequence: Synthetic peptide
  XENP024265 vhCDR1
HYGMN

SEQ ID NO: 1767 - protein, 17 aa, Artificial Sequence
  Description of Artificial Sequence: Synthetic peptide
  XENP024265 vhCDR2
WINTYTGEPTYSDGFTG

SEQ ID NO: 1768 - protein, 8 aa, Artificial Sequence
  Description of Artificial Sequence: Synthetic peptide
  XENP024265 vhCDR3
DYYGSSPY

SEQ ID NO: 1769 - protein, 16 aa, Artificial Sequence
  Description of Artificial Sequence: Synthetic peptide
  XENP024265 vlCDR1
KSSQSIVHSNGNTYLE

SEQ ID NO: 1770 - protein, 7 aa, Artificial Sequence
  Description of Artificial Sequence: Synthetic peptide
  XENP024265 vlCDR2
KVSNRFS

SEQ ID NO: 1771 - protein, 9 aa, Artificial Sequence
  Description of Artificial Sequence: Synthetic peptide
  XENP024265 vlCDR3
FQGSHVPNT

SEQ ID NO: 1772 - protein, 251 aa, Artificial Sequence
  Description of Artificial Sequence: Synthetic polypeptide
  XENP024266 1C11_H3.146_L3_scFv
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1773 - protein, 117 aa, Artificial Sequence
  Description of Artificial Sequence: Synthetic polypeptide
  VH of XENP024266
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSS

SEQ ID NO: 1774 - protein, 114 aa, Artificial Sequence; identical to SEQ ID NO: 649
  Description of Artificial Sequence: Synthetic polypeptide
  VL of XENP024266

SEQ ID NO: 1775 - protein, 5 aa, Artificial Sequence
  Description of Artificial Sequence: Synthetic peptide
  XENP024266 vhCDR1
HYGMN

SEQ ID NO: 1776 - protein, 17 aa, Artificial Sequence
  Description of Artificial Sequence: Synthetic peptide
  XENP024266 vhCDR2
WINTYTGEPTYAPGFTG

SEQ ID NO: 1777 - protein, 8 aa, Artificial Sequence
  Description of Artificial Sequence: Synthetic peptide
  XENP024266 vhCDR3
DYYGSSPY

SEQ ID NO: 1778 - protein, 16 aa, Artificial Sequence
  Description of Artificial Sequence: Synthetic peptide
  XENP024266 vlCDR1
KSSQSIVHSNGNTYLE

SEQ ID NO: 1779 - protein, 7 aa, Artificial Sequence
  Description of Artificial Sequence: Synthetic peptide
  XENP024266 vlCDR2
KVSNRFS

SEQ ID NO: 1780 - protein, 9 aa, Artificial Sequence
  Description of Artificial Sequence: Synthetic peptide
  XENP024266 vlCDR3
FQGSHVPNT

SEQ ID NO: 1781 - protein, 251 aa, Artificial Sequence
  Description of Artificial Sequence: Synthetic polypeptide
  XENP024267 1C11_H3.147_L3_scFv
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1782 - protein, 117 aa, Artificial Sequence
  Description of Artificial Sequence: Synthetic polypeptide
  VH of XENP024267
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSS

SEQ ID NO: 1783 - protein, 114 aa, Artificial Sequence; identical to SEQ ID NO: 649
  Description of Artificial Sequence: Synthetic polypeptide
  VL of XENP024267

SEQ ID NO: 1784 - protein, 5 aa, Artificial Sequence
  Description of Artificial Sequence: Synthetic peptide
  XENP024267 vhCDR1
HYGMN

SEQ ID NO: 1785 - protein, 17 aa, Artificial Sequence
  Description of Artificial Sequence: Synthetic peptide
  XENP024267 vhCDR2
WINTYTGEPTYATGFTG

SEQ ID NO: 1786 - protein, 8 aa, Artificial Sequence
  Description of Artificial Sequence: Synthetic peptide
  XENP024267 vhCDR3
DYYGSSPY

SEQ ID NO: 1787 - protein, 16 aa, Artificial Sequence
  Description of Artificial Sequence: Synthetic peptide
  XENP024267 vlCDR1
KSSQSIVHSNGNTYLE

SEQ ID NO: 1788 - protein, 7 aa, Artificial Sequence
  Description of Artificial Sequence: Synthetic peptide
  XENP024267 vlCDR2
KVSNRFS

SEQ ID NO: 1789 - protein, 9 aa, Artificial Sequence
  Description of Artificial Sequence: Synthetic peptide
  XENP024267 vlCDR3
FQGSHVPNT

SEQ ID NO: 1790 - protein, 251 aa, Artificial Sequence
  Description of Artificial Sequence: Synthetic polypeptide
  XENP024268 1C11_H3.148_L3_scFv
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1791 - protein, 117 aa, Artificial Sequence
  Description of Artificial Sequence: Synthetic polypeptide
  VH of XENP024268
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSS

SEQ ID NO: 1792 - protein, 114 aa, Artificial Sequence; identical to SEQ ID NO: 649
  Description of Artificial Sequence: Synthetic polypeptide
  VL of XENP024268

SEQ ID NO: 1793 - protein, 5 aa, Artificial Sequence
  Description of Artificial Sequence: Synthetic peptide
  XENP024268 vhCDR1
HYGMN

SEQ ID NO: 1794 - protein, 17 aa, Artificial Sequence
  Description of Artificial Sequence: Synthetic peptide
  XENP024268 vhCDR2
WINTYTGEPTYAQKFTG

SEQ ID NO: 1795 - protein, 8 aa, Artificial Sequence
  Description of Artificial Sequence: Synthetic peptide
  XENP024268 vhCDR3
DYYGSSPY

SEQ ID NO: 1796 - protein, 16 aa, Artificial Sequence
  Description of Artificial Sequence: Synthetic peptide
  XENP024268 vlCDR1
KSSQSIVHSNGNTYLE

SEQ ID NO: 1797 - protein, 7 aa, Artificial Sequence
  Description of Artificial Sequence: Synthetic peptide
  XENP024268 vlCDR2
KVSNRFS

SEQ ID NO: 1798 - protein, 9 aa, Artificial Sequence
  Description of Artificial Sequence: Synthetic peptide
  XENP024268 vlCDR3
FQGSHVPNT

SEQ ID NO: 1799 - protein, 251 aa, Artificial Sequence
  Description of Artificial Sequence: Synthetic polypeptide
  XENP024269 1C11_H3.149_L3_scFv
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1800 - protein, 117 aa, Artificial Sequence
  Description of Artificial Sequence: Synthetic polypeptide
  VH of XENP024269
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSS

SEQ ID NO: 1801 - protein, 114 aa, Artificial Sequence; identical to SEQ ID NO: 649
  Description of Artificial Sequence: Synthetic polypeptide
  VL of XENP024269

SEQ ID NO: 1802 - protein, 5 aa, Artificial Sequence
  Description of Artificial Sequence: Synthetic peptide
  XENP024269 vhCDR1
HYGMN

SEQ ID NO: 1803 - protein, 17 aa, Artificial Sequence
  Description of Artificial Sequence: Synthetic peptide
  XENP024269 vhCDR2
WINTYTGEPTYADGFTD

SEQ ID NO: 1804 - protein, 8 aa, Artificial Sequence
  Description of Artificial Sequence: Synthetic peptide
  XENP024269 vhCDR3
DYYGSSPY

SEQ ID NO: 1805 - protein, 16 aa, Artificial Sequence
  Description of Artificial Sequence: Synthetic peptide
  XENP024269 vlCDR1
KSSQSIVHSNGNTYLE

SEQ ID NO: 1806 - protein, 7 aa, Artificial Sequence
  Description of Artificial Sequence: Synthetic peptide
  XENP024269 vlCDR2
KVSNRFS

SEQ ID NO: 1807 - protein, 9 aa, Artificial Sequence
  Description of Artificial Sequence: Synthetic peptide
  XENP024269 vlCDR3
FQGSHVPNT

SEQ ID NO: 1808 - protein, 251 aa, Artificial Sequence
  Description of Artificial Sequence: Synthetic polypeptide
  XENP024270 1C11_H3.150_L3_scFv
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1809 - protein, 117 aa, Artificial Sequence
  Description of Artificial Sequence: Synthetic polypeptide
  VH of XENP024270
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSS

SEQ ID NO: 1810 - protein, 114 aa, Artificial Sequence; identical to SEQ ID NO: 649
  Description of Artificial Sequence: Synthetic polypeptide
  VL of XENP024270

SEQ ID NO: 1811 - protein, 5 aa, Artificial Sequence
  Description of Artificial Sequence: Synthetic peptide
  XENP024270 vhCDR1
HYGMN

SEQ ID NO: 1812 - protein, 17 aa, Artificial Sequence
  Description of Artificial Sequence: Synthetic peptide
  XENP024270 vhCDR2
WINTYTGEPTYADGFTE

SEQ ID NO: 1813 - protein, 8 aa, Artificial Sequence
  Description of Artificial Sequence: Synthetic peptide
  XENP024270 vhCDR3
DYYGSSPY

SEQ ID NO: 1814 - protein, 16 aa, Artificial Sequence
  Description of Artificial Sequence: Synthetic peptide
  XENP024270 vlCDR1
KSSQSIVHSNGNTYLE

SEQ ID NO: 1815 - protein, 7 aa, Artificial Sequence
  Description of Artificial Sequence: Synthetic peptide
  XENP024270 vlCDR2
KVSNRFS

SEQ ID NO: 1816 - protein, 9 aa, Artificial Sequence
  Description of Artificial Sequence: Synthetic peptide
  XENP024270 vlCDR3
FQGSHVPNT

SEQ ID NO: 1817 - protein, 251 aa, Artificial Sequence
  Description of Artificial Sequence: Synthetic polypeptide
  XENP024271 1C11_H3.151_L3_scFv
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1818 - protein, 117 aa, Artificial Sequence
  Description of Artificial Sequence: Synthetic polypeptide
  VH of XENP024271
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSS

SEQ ID NO: 1819 - protein, 114 aa, Artificial Sequence; identical to SEQ ID NO: 649
  Description of Artificial Sequence: Synthetic polypeptide
  VL of XENP024271

SEQ ID NO: 1820 - protein, 5 aa, Artificial Sequence
  Description of Artificial Sequence: Synthetic peptide
  XENP024271 vhCDR1
HYGMN

SEQ ID NO: 1821 - protein, 17 aa, Artificial Sequence
  Description of Artificial Sequence: Synthetic peptide
  XENP024271 vhCDR2
WINTYTGEPTYADGFTS

SEQ ID NO: 1822 - protein, 8 aa, Artificial Sequence
  Description of Artificial Sequence: Synthetic peptide
  XENP024271 vhCDR3
DYYGSSPY

SEQ ID NO: 1823 - protein, 16 aa, Artificial Sequence
  Description of Artificial Sequence: Synthetic peptide
  XENP024271 vlCDR1
KSSQSIVHSNGNTYLE

SEQ ID NO: 1824 - protein, 7 aa, Artificial Sequence
  Description of Artificial Sequence: Synthetic peptide
  XENP024271 vlCDR2
KVSNRFS

SEQ ID NO: 1825 - protein, 9 aa, Artificial Sequence
  Description of Artificial Sequence: Synthetic peptide
  XENP024271 vlCDR3
FQGSHVPNT

SEQ ID NO: 1826 - protein, 251 aa, Artificial Sequence
  Description of Artificial Sequence: Synthetic polypeptide
  XENP024272 1C11_H3.152_L3_scFv
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1827 - protein, 117 aa, Artificial Sequence
  Description of Artificial Sequence: Synthetic polypeptide
  VH of XENP024272
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSS

SEQ ID NO: 1828 - protein, 114 aa, Artificial Sequence; identical to SEQ ID NO: 649
  Description of Artificial Sequence: Synthetic polypeptide
  VL of XENP024272

SEQ ID NO: 1829 - protein, 5 aa, Artificial Sequence
  Description of Artificial Sequence: Synthetic peptide
  XENP024272 vhCDR1
HYGMN

SEQ ID NO: 1830 - protein, 17 aa, Artificial Sequence
  Description of Artificial Sequence: Synthetic peptide
  XENP024272 vhCDR2
WINTYTGEPTYADGFTG

SEQ ID NO: 1831 - protein, 8 aa, Artificial Sequence
  Description of Artificial Sequence: Synthetic peptide
  XENP024272 vhCDR3
DYYGSSPY

SEQ ID NO: 1832 - protein, 16 aa, Artificial Sequence
  Description of Artificial Sequence: Synthetic peptide
  XENP024272 vlCDR1
KSSQSIVHSNGNTYLE

SEQ ID NO: 1833 - protein, 7 aa, Artificial Sequence
  Description of Artificial Sequence: Synthetic peptide
  XENP024272 vlCDR2
KVSNRFS

SEQ ID NO: 1834 - protein, 9 aa, Artificial Sequence
  Description of Artificial Sequence: Synthetic peptide
  XENP024272 vlCDR3
FQGSHVPNT

SEQ ID NO: 1835 - protein, 251 aa, Artificial Sequence
  Description of Artificial Sequence: Synthetic polypeptide
  XENP024273 1C11_H3.153_L3_scFv
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1836 - protein, 117 aa, Artificial Sequence
  Description of Artificial Sequence: Synthetic polypeptide
  VH of XENP024273
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSS

SEQ ID NO: 1837 - protein, 114 aa, Artificial Sequence; identical to SEQ ID NO: 649
  Description of Artificial Sequence: Synthetic polypeptide
  VL of XENP024273

SEQ ID NO: 1838 - protein, 5 aa, Artificial Sequence
  Description of Artificial Sequence: Synthetic peptide
  XENP024273 vhCDR1
HYGMN

SEQ ID NO: 1839 - protein, 17 aa, Artificial Sequence
  Description of Artificial Sequence: Synthetic peptide
  XENP024273 vhCDR2
WINTYTGEPTYADGFTG

SEQ ID NO: 1840 - protein, 8 aa, Artificial Sequence
  Description of Artificial Sequence: Synthetic peptide
  XENP024273 vhCDR3
DYYGSSPY

SEQ ID NO: 1841 - protein, 16 aa, Artificial Sequence
  Description of Artificial Sequence: Synthetic peptide
  XENP024273 vlCDR1
KSSQSIVHSNGNTYLE

SEQ ID NO: 1842 - protein, 7 aa, Artificial Sequence
  Description of Artificial Sequence: Synthetic peptide
  XENP024273 vlCDR2
KVSNRFS

SEQ ID NO: 1843 - protein, 9 aa, Artificial Sequence
  Description of Artificial Sequence: Synthetic peptide
  XENP024273 vlCDR3
FQGSHVPNT

SEQ ID NO: 1844 - protein, 251 aa, Artificial Sequence
  Description of Artificial Sequence: Synthetic polypeptide
  XENP024274 1C11_H3.154_L3_scFv
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1845 - protein, 117 aa, Artificial Sequence
  Description of Artificial Sequence: Synthetic polypeptide
  VH of XENP024274
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSS

SEQ ID NO: 1846 - protein, 114 aa, Artificial Sequence; identical to SEQ ID NO: 649
  Description of Artificial Sequence: Synthetic polypeptide
  VL of XENP024274

SEQ ID NO: 1847 - protein, 5 aa, Artificial Sequence
  Description of Artificial Sequence: Synthetic peptide
  XENP024274 vhCDR1
HYGMN

SEQ ID NO: 1848 - protein, 17 aa, Artificial Sequence
  Description of Artificial Sequence: Synthetic peptide
  XENP024274 vhCDR2
WINTYTGEPTYADGFTG

SEQ ID NO: 1849 - protein, 8 aa, Artificial Sequence
  Description of Artificial Sequence: Synthetic peptide
  XENP024274 vhCDR3
DYYGSSPY

SEQ ID NO: 1850 - protein, 16 aa, Artificial Sequence
  Description of Artificial Sequence: Synthetic peptide
  XENP024274 vlCDR1
KSSQSIVHSNGNTYLE

SEQ ID NO: 1851 - protein, 7 aa, Artificial Sequence
  Description of Artificial Sequence: Synthetic peptide
  XENP024274 vlCDR2
KVSNRFS

SEQ ID NO: 1852 - protein, 9 aa, Artificial Sequence
  Description of Artificial Sequence: Synthetic peptide
  XENP024274 vlCDR3
FQGSHVPNT

SEQ ID NO: 1853 - protein, 251 aa, Artificial Sequence
  Description of Artificial Sequence: Synthetic polypeptide
  XENP024275 1C11_H3.155_L3_scFv
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1854 - protein, 117 aa, Artificial Sequence
  Description of Artificial Sequence: Synthetic polypeptide
  VH of XENP024275
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSS

SEQ ID NO: 1855 - protein, 114 aa, Artificial Sequence; identical to SEQ ID NO: 649
  Description of Artificial Sequence: Synthetic polypeptide
  VL of XENP024275

SEQ ID NO: 1856 - protein, 5 aa, Artificial Sequence
  Description of Artificial Sequence: Synthetic peptide
  XENP024275 vhCDR1
HYGMN

SEQ ID NO: 1857 - protein, 17 aa, Artificial Sequence
  Description of Artificial Sequence: Synthetic peptide
  XENP024275 vhCDR2
WINTYTGEPTYADGFTG

SEQ ID NO: 1858 - protein, 8 aa, Artificial Sequence
  Description of Artificial Sequence: Synthetic peptide
  XENP024275 vhCDR3
DYYGSSPY

SEQ ID NO: 1859 - protein, 16 aa, Artificial Sequence
  Description of Artificial Sequence: Synthetic peptide
  XENP024275 vlCDR1
KSSQSIVHSNGNTYLE

SEQ ID NO: 1860 - protein, 7 aa, Artificial Sequence
  Description of Artificial Sequence: Synthetic peptide
  XENP024275 vlCDR2
KVSNRFS

SEQ ID NO: 1861 - protein, 9 aa, Artificial Sequence
  Description of Artificial Sequence: Synthetic peptide
  XENP024275 vlCDR3
FQGSHVPNT

SEQ ID NO: 1862 - protein, 251 aa, Artificial Sequence
  Description of Artificial Sequence: Synthetic polypeptide
  XENP024276 1C11_H3.156_L3_scFv
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1863 - protein, 117 aa, Artificial Sequence
  Description of Artificial Sequence: Synthetic polypeptide
  VH of XENP024276
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSS

SEQ ID NO: 1864 - protein, 114 aa, Artificial Sequence; identical to SEQ ID NO: 649
  Description of Artificial Sequence: Synthetic polypeptide
  VL of XENP024276

SEQ ID NO: 1865 - protein, 5 aa, Artificial Sequence
  Description of Artificial Sequence: Synthetic peptide
  XENP024276 vhCDR1
HYGMN

SEQ ID NO: 1866 - protein, 17 aa, Artificial Sequence
  Description of Artificial Sequence: Synthetic peptide
  XENP024276 vhCDR2
WINTYTGEPTYADGFTG

SEQ ID NO: 1867 - protein, 8 aa, Artificial Sequence
  Description of Artificial Sequence: Synthetic peptide
  XENP024276 vhCDR3
DYYGSSPY

SEQ ID NO: 1868 - protein, 16 aa, Artificial Sequence
  Description of Artificial Sequence: Synthetic peptide
  XENP024276 vlCDR1
KSSQSIVHSNGNTYLE

SEQ ID NO: 1869 - protein, 7 aa, Artificial Sequence
  Description of Artificial Sequence: Synthetic peptide
  XENP024276 vlCDR2
KVSNRFS

SEQ ID NO: 1870 - protein, 9 aa, Artificial Sequence
  Description of Artificial Sequence: Synthetic peptide
  XENP024276 vlCDR3
FQGSHVPNT

SEQ ID NO: 1871 - protein, 251 aa, Artificial Sequence
  Description of Artificial Sequence: Synthetic polypeptide
  XENP024277 1C11_H3.157_L3_scFv
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1872 - protein, 117 aa, Artificial Sequence
  Description of Artificial Sequence: Synthetic polypeptide
  VH of XENP024277
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSS

SEQ ID NO: 1873 - protein, 114 aa, Artificial Sequence; identical to SEQ ID NO: 649
  Description of Artificial Sequence: Synthetic polypeptide
  VL of XENP024277

SEQ ID NO: 1874 - protein, 5 aa, Artificial Sequence
  Description of Artificial Sequence: Synthetic peptide
  XENP024277 vhCDR1
HYGMN

SEQ ID NO: 1875 - protein, 17 aa, Artificial Sequence
  Description of Artificial Sequence: Synthetic peptide
  XENP024277 vhCDR2
WINTYTGEPTYADGFTG

SEQ ID NO: 1876 - protein, 8 aa, Artificial Sequence
  Description of Artificial Sequence: Synthetic peptide
  XENP024277 vhCDR3
DYYGSSPY

SEQ ID NO: 1877 - protein, 16 aa, Artificial Sequence
  Description of Artificial Sequence: Synthetic peptide
  XENP024277 vlCDR1
KSSQSIVHSNGNTYLE

SEQ ID NO: 1878 - protein, 7 aa, Artificial Sequence
  Description of Artificial Sequence: Synthetic peptide
  XENP024277 vlCDR2
KVSNRFS

SEQ ID NO: 1879 - protein, 9 aa, Artificial Sequence
  Description of Artificial Sequence: Synthetic peptide
  XENP024277 vlCDR3
FQGSHVPNT

SEQ ID NO: 1880 - protein, 251 aa, Artificial Sequence
  Description of Artificial Sequence: Synthetic polypeptide
  XENP024278 1C11_H3.158_L3_scFv
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1881 - protein, 117 aa, Artificial Sequence
  Description of Artificial Sequence: Synthetic polypeptide
  VH of XENP024278
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSS

SEQ ID NO: 1882 - protein, 114 aa, Artificial Sequence; identical to SEQ ID NO: 649
  Description of Artificial Sequence: Synthetic polypeptide
  VL of XENP024278

SEQ ID NO: 1883 - protein, 5 aa, Artificial Sequence
  Description of Artificial Sequence: Synthetic peptide
  XENP024278 vhCDR1
HYGMN

SEQ ID NO: 1884 - protein, 17 aa, Artificial Sequence
  Description of Artificial Sequence: Synthetic peptide
  XENP024278 vhCDR2
WINTYTGEPTYADGFTG

SEQ ID NO: 1885 - protein, 8 aa, Artificial Sequence
  Description of Artificial Sequence: Synthetic peptide
  XENP024278 vhCDR3
DYYGSSPY

SEQ ID NO: 1886 - protein, 16 aa, Artificial Sequence
  Description of Artificial Sequence: Synthetic peptide
  XENP024278 vlCDR1
KSSQSIVHSNGNTYLE

SEQ ID NO: 1887 - protein, 7 aa, Artificial Sequence
  Description of Artificial Sequence: Synthetic peptide
  XENP024278 vlCDR2
KVSNRFS

SEQ ID NO: 1888 - protein, 9 aa, Artificial Sequence
  Description of Artificial Sequence: Synthetic peptide
  XENP024278 vlCDR3
FQGSHVPNT

SEQ ID NO: 1889 - protein, 251 aa, Artificial Sequence
  Description of Artificial Sequence: Synthetic polypeptide
  XENP024279 1C11_H3.159_L3_scFv
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1890 - protein, 117 aa, Artificial Sequence
  Description of Artificial Sequence: Synthetic polypeptide
  VH of XENP024279
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSS

SEQ ID NO: 1891 - protein, 114 aa, Artificial Sequence; identical to SEQ ID NO: 649
  Description of Artificial Sequence: Synthetic polypeptide
  VL of XENP024279

SEQ ID NO: 1892 - protein, 5 aa, Artificial Sequence
  Description of Artificial Sequence: Synthetic peptide
  XENP024279 vhCDR1
HYGMN

SEQ ID NO: 1893 - protein, 17 aa, Artificial Sequence
  Description of Artificial Sequence: Synthetic peptide
  XENP024279 vhCDR2
WINTYTGEPTYADGFTG

SEQ ID NO: 1894 - protein, 8 aa, Artificial Sequence
  Description of Artificial Sequence: Synthetic peptide
  XENP024279 vhCDR3
DYYGSSPY

SEQ ID NO: 1895 - protein, 16 aa, Artificial Sequence
  Description of Artificial Sequence: Synthetic peptide
  XENP024279 vlCDR1
KSSQSIVHSNGNTYLE

SEQ ID NO: 1896 - protein, 7 aa, Artificial Sequence
  Description of Artificial Sequence: Synthetic peptide
  XENP024279 vlCDR2
KVSNRFS

SEQ ID NO: 1897 - protein, 9 aa, Artificial Sequence
  Description of Artificial Sequence: Synthetic peptide
  XENP024279 vlCDR3
FQGSHVPNT

SEQ ID NO: 1898 - protein, 251 aa, Artificial Sequence
  Description of Artificial Sequence: Synthetic polypeptide
  XENP024280 1C11_H3.160_L3_scFv
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1899 - protein, 117 aa, Artificial Sequence
  Description of Artificial Sequence: Synthetic polypeptide
  VH of XENP024280
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSS

SEQ ID NO: 1900 - protein, 114 aa, Artificial Sequence; identical to SEQ ID NO: 649
  Description of Artificial Sequence: Synthetic polypeptide
  VL of XENP024280

SEQ ID NO: 1901 - protein, 5 aa, Artificial Sequence
  Description of Artificial Sequence: Synthetic peptide
  XENP024280 vhCDR1
HYGMN

SEQ ID NO: 1902 - protein, 17 aa, Artificial Sequence
  Description of Artificial Sequence: Synthetic peptide
  XENP024280 vhCDR2
WINTYTGEPTYADGFTG

SEQ ID NO: 1903 - protein, 8 aa, Artificial Sequence
  Description of Artificial Sequence: Synthetic peptide
  XENP024280 vhCDR3
DYYGSSPY

SEQ ID NO: 1904 - protein, 16 aa, Artificial Sequence
  Description of Artificial Sequence: Synthetic peptide
  XENP024280 vlCDR1
KSSQSIVHSNGNTYLE

SEQ ID NO: 1905 - protein, 7 aa, Artificial Sequence
  Description of Artificial Sequence: Synthetic peptide
  XENP024280 vlCDR2
KVSNRFS

SEQ ID NO: 1906 - protein, 9 aa, Artificial Sequence
  Description of Artificial Sequence: Synthetic peptide
  XENP024280 vlCDR3
FQGSHVPNT

SEQ ID NO: 1907 - protein, 251 aa, Artificial Sequence
  Description of Artificial Sequence: Synthetic polypeptide
  XENP024281 1C11_H3.161_L3_scFv
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1908 - protein, 117 aa, Artificial Sequence
  Description of Artificial Sequence: Synthetic polypeptide
  VH of XENP024281
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSS

SEQ ID NO: 1909 - protein, 114 aa, Artificial Sequence; identical to SEQ ID NO: 649
  Description of Artificial Sequence: Synthetic polypeptide
  VL of XENP024281

SEQ ID NO: 1910 - protein, 5 aa, Artificial Sequence
  Description of Artificial Sequence: Synthetic peptide
  XENP024281 vhCDR1
HYGMN

SEQ ID NO: 1911 - protein, 17 aa, Artificial Sequence
  Description of Artificial Sequence: Synthetic peptide
  XENP024281 vhCDR2
WINTYTGEPTYADGFTG

SEQ ID NO: 1912 - protein, 8 aa, Artificial Sequence
  Description of Artificial Sequence: Synthetic peptide
  XENP024281 vhCDR3
DYYGSSPY

SEQ ID NO: 1913 - protein, 16 aa, Artificial Sequence
  Description of Artificial Sequence: Synthetic peptide
  XENP024281 vlCDR1
KSSQSIVHSNGNTYLE

SEQ ID NO: 1914 - protein, 7 aa, Artificial Sequence
  Description of Artificial Sequence: Synthetic peptide
  XENP024281 vlCDR2
KVSNRFS

SEQ ID NO: 1915 - protein, 9 aa, Artificial Sequence
  Description of Artificial Sequence: Synthetic peptide
  XENP024281 vlCDR3
FQGSHVPNT

SEQ ID NO: 1916 - protein, 251 aa, Artificial Sequence
  Description of Artificial Sequence: Synthetic polypeptide
  XENP024282 1C11_H3.162_L3_scFv
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1917 - protein, 117 aa, Artificial Sequence
  Description of Artificial Sequence: Synthetic polypeptide
  VH of XENP024282
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSS

SEQ ID NO: 1918 - protein, 114 aa, Artificial Sequence; identical to SEQ ID NO: 649
  Description of Artificial Sequence: Synthetic polypeptide
  VL of XENP024282

SEQ ID NO: 1919 - protein, 5 aa, Artificial Sequence
  Description of Artificial Sequence: Synthetic peptide
  XENP024282 vhCDR1
HYGMN

SEQ ID NO: 1920 - protein, 17 aa, Artificial Sequence
  Description of Artificial Sequence: Synthetic peptide
  XENP024282 vhCDR2
WINTYTGEPTYADGFTG

SEQ ID NO: 1921 - protein, 8 aa, Artificial Sequence
  Description of Artificial Sequence: Synthetic peptide
  XENP024282 vhCDR3
DYYGSSPY

SEQ ID NO: 1922 - protein, 16 aa, Artificial Sequence
  Description of Artificial Sequence: Synthetic peptide
  XENP024282 vlCDR1
KSSQSIVHSNGNTYLE

SEQ ID NO: 1923 - protein, 7 aa, Artificial Sequence
  Description of Artificial Sequence: Synthetic peptide
  XENP024282 vlCDR2
KVSNRFS

SEQ ID NO: 1924 - protein, 9 aa, Artificial Sequence
  Description of Artificial Sequence: Synthetic peptide
  XENP024282 vlCDR3
FQGSHVPNT

SEQ ID NO: 1925 - protein, 251 aa, Artificial Sequence
  Description of Artificial Sequence: Synthetic polypeptide
  XENP024283 1C11_H3.164_L3_scFv
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1926 - protein, 117 aa, Artificial Sequence
  Description of Artificial Sequence: Synthetic polypeptide
  VH of XENP024283
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSS

SEQ ID NO: 1927 - protein, 114 aa, Artificial Sequence; identical to SEQ ID NO: 649
  Description of Artificial Sequence: Synthetic polypeptide
  VL of XENP024283

SEQ ID NO: 1928 - protein, 5 aa, Artificial Sequence
  Description of Artificial Sequence: Synthetic peptide
  XENP024283 vhCDR1
HYGMN

SEQ ID NO: 1929 - protein, 17 aa, Artificial Sequence
  Description of Artificial Sequence: Synthetic peptide
  XENP024283 vhCDR2
WINTYTGEPTYADGFTG

SEQ ID NO: 1930 - protein, 8 aa, Artificial Sequence
  Description of Artificial Sequence: Synthetic peptide
  XENP024283 vhCDR3
DYYGSSPY

SEQ ID NO: 1931 - protein, 16 aa, Artificial Sequence
  Description of Artificial Sequence: Synthetic peptide
  XENP024283 vlCDR1
KSSQSIVHSNGNTYLE

SEQ ID NO: 1932 - protein, 7 aa, Artificial Sequence
  Description of Artificial Sequence: Synthetic peptide
  XENP024283 vlCDR2
KVSNRFS

SEQ ID NO: 1933 - protein, 9 aa, Artificial Sequence
  Description of Artificial Sequence: Synthetic peptide
  XENP024283 vlCDR3
FQGSHVPNT

SEQ ID NO: 1934 - protein, 251 aa, Artificial Sequence
  Description of Artificial Sequence: Synthetic polypeptide
  XENP024284 1C11_H3.165_L3_scFv
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1935 - protein, 117 aa, Artificial Sequence
  Description of Artificial Sequence: Synthetic polypeptide
  VH of XENP024284
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSS

SEQ ID NO: 1936 - protein, 114 aa, Artificial Sequence; identical to SEQ ID NO: 649
  Description of Artificial Sequence: Synthetic polypeptide
  VL of XENP024284

SEQ ID NO: 1937 - protein, 5 aa, Artificial Sequence
  Description of Artificial Sequence: Synthetic peptide
  XENP024284 vhCDR1
HYGMN

SEQ ID NO: 1938 - protein, 17 aa, Artificial Sequence
  Description of Artificial Sequence: Synthetic peptide
  XENP024284 vhCDR2
WINTYTGEPTYADGFTG

SEQ ID NO: 1939 - protein, 8 aa, Artificial Sequence
  Description of Artificial Sequence: Synthetic peptide
  XENP024284 vhCDR3
DYYGSSPY

SEQ ID NO: 1940 - protein, 16 aa, Artificial Sequence
  Description of Artificial Sequence: Synthetic peptide
  XENP024284 vlCDR1
KSSQSIVHSNGNTYLE

SEQ ID NO: 1941 - protein, 7 aa, Artificial Sequence
  Description of Artificial Sequence: Synthetic peptide
  XENP024284 vlCDR2
KVSNRFS

SEQ ID NO: 1942 - protein, 9 aa, Artificial Sequence
  Description of Artificial Sequence: Synthetic peptide
  XENP024284 vlCDR3
FQGSHVPNT

SEQ ID NO: 1943 - protein, 251 aa, Artificial Sequence
  Description of Artificial Sequence: Synthetic polypeptide
  XENP024285 1C11_H3.166_L3_scFv
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1944 - protein, 117 aa, Artificial Sequence
  Description of Artificial Sequence: Synthetic polypeptide
  VH of XENP024285
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSS

SEQ ID NO: 1945 - protein, 114 aa, Artificial Sequence; identical to SEQ ID NO: 649
  Description of Artificial Sequence: Synthetic polypeptide
  VL of XENP024285

SEQ ID NO: 1946 - protein, 5 aa, Artificial Sequence
  Description of Artificial Sequence: Synthetic peptide
  XENP024285 vhCDR1
HYGMN

SEQ ID NO: 1947 - protein, 17 aa, Artificial Sequence
  Description of Artificial Sequence: Synthetic peptide
  XENP024285 vhCDR2
WINTYTGEPTYADGFTG

SEQ ID NO: 1948 - protein, 8 aa, Artificial Sequence
  Description of Artificial Sequence: Synthetic peptide
  XENP024285 vhCDR3
DYYGSSPY

SEQ ID NO: 1949 - protein, 16 aa, Artificial Sequence
  Description of Artificial Sequence: Synthetic peptide
  XENP024285 vlCDR1
KSSQSIVHSNGNTYLE

SEQ ID NO: 1950 - protein, 7 aa, Artificial Sequence
  Description of Artificial Sequence: Synthetic peptide
  XENP024285 vlCDR2
KVSNRFS

SEQ ID NO: 1951 - protein, 9 aa, Artificial Sequence
  Description of Artificial Sequence: Synthetic peptide
  XENP024285 vlCDR3
FQGSHVPNT

SEQ ID NO: 1952 - protein, 251 aa, Artificial Sequence
  Description of Artificial Sequence: Synthetic polypeptide
  XENP024286 1C11_H3.167_L3_scFv
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1953 - protein, 117 aa, Artificial Sequence
  Description of Artificial Sequence: Synthetic polypeptide
  VH of XENP024286
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSS

SEQ ID NO: 1954 - protein, 114 aa, Artificial Sequence; identical to SEQ ID NO: 649
  Description of Artificial Sequence: Synthetic polypeptide
  VL of XENP024286

SEQ ID NO: 1955 - protein, 5 aa, Artificial Sequence
  Description of Artificial Sequence: Synthetic peptide
  XENP024286 vhCDR1
HYGMN

SEQ ID NO: 1956 - protein, 17 aa, Artificial Sequence
  Description of Artificial Sequence: Synthetic peptide
  XENP024286 vhCDR2
WINTYTGEPTYADGFTG

SEQ ID NO: 1957 - protein, 8 aa, Artificial Sequence
  Description of Artificial Sequence: Synthetic peptide
  XENP024286 vhCDR3
DYYGSSPY

SEQ ID NO: 1958 - protein, 16 aa, Artificial Sequence
  Description of Artificial Sequence: Synthetic peptide
  XENP024286 vlCDR1
KSSQSIVHSNGNTYLE

SEQ ID NO: 1959 - protein, 7 aa, Artificial Sequence
  Description of Artificial Sequence: Synthetic peptide
  XENP024286 vlCDR2
KVSNRFS

SEQ ID NO: 1960 - protein, 9 aa, Artificial Sequence
  Description of Artificial Sequence: Synthetic peptide
  XENP024286 vlCDR3
FQGSHVPNT

SEQ ID NO: 1961 - protein, 251 aa, Artificial Sequence
  Description of Artificial Sequence: Synthetic polypeptide
  XENP024287 1C11_H3.168_L3_scFv
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1962 - protein, 117 aa, Artificial Sequence
  Description of Artificial Sequence: Synthetic polypeptide
  VH of XENP024287
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSS

SEQ ID NO: 1963 - protein, 114 aa, Artificial Sequence; identical to SEQ ID NO: 649
  Description of Artificial Sequence: Synthetic polypeptide
  VL of XENP024287

SEQ ID NO: 1964 - protein, 5 aa, Artificial Sequence
  Description of Artificial Sequence: Synthetic peptide
  XENP024287 vhCDR1
HYGMN

SEQ ID NO: 1965 - protein, 17 aa, Artificial Sequence
  Description of Artificial Sequence: Synthetic peptide
  XENP024287 vhCDR2
WINTYTGEPTYADGFTG

SEQ ID NO: 1966 - protein, 8 aa, Artificial Sequence
  Description of Artificial Sequence: Synthetic peptide
  XENP024287 vhCDR3
DYYGSSPY

SEQ ID NO: 1967 - protein, 16 aa, Artificial Sequence
  Description of Artificial Sequence: Synthetic peptide
  XENP024287 vlCDR1
KSSQSIVHSNGNTYLE

SEQ ID NO: 1968 - protein, 7 aa, Artificial Sequence
  Description of Artificial Sequence: Synthetic peptide
  XENP024287 vlCDR2
KVSNRFS

SEQ ID NO: 1969 - protein, 9 aa, Artificial Sequence
  Description of Artificial Sequence: Synthetic peptide
  XENP024287 vlCDR3
FQGSHVPNT

SEQ ID NO: 1970 - protein, 251 aa, Artificial Sequence
  Description of Artificial Sequence: Synthetic polypeptide
  XENP024288 1C11_H3.169_L3_scFv
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1971 - protein, 117 aa, Artificial Sequence
  Description of Artificial Sequence: Synthetic polypeptide
  VH of XENP024288
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSS

SEQ ID NO: 1972 - protein, 114 aa, Artificial Sequence; identical to SEQ ID NO: 649
  Description of Artificial Sequence: Synthetic polypeptide
  VL of XENP024288

SEQ ID NO: 1973 - protein, 5 aa, Artificial Sequence
  Description of Artificial Sequence: Synthetic peptide
  XENP024288 vhCDR1
HYGMN

SEQ ID NO: 1974 - protein, 17 aa, Artificial Sequence
  Description of Artificial Sequence: Synthetic peptide
  XENP024288 vhCDR2
WINTYTGEPTYADGFTG

SEQ ID NO: 1975 - protein, 8 aa, Artificial Sequence
  Description of Artificial Sequence: Synthetic peptide
  XENP024288 vhCDR3
DYYGSSPY

SEQ ID NO: 1976 - protein, 16 aa, Artificial Sequence
  Description of Artificial Sequence: Synthetic peptide
  XENP024288 vlCDR1
KSSQSIVHSNGNTYLE

SEQ ID NO: 1977 - protein, 7 aa, Artificial Sequence
  Description of Artificial Sequence: Synthetic peptide
  XENP024288 vlCDR2
KVSNRFS

SEQ ID NO: 1978 - protein, 9 aa, Artificial Sequence
  Description of Artificial Sequence: Synthetic peptide
  XENP024288 vlCDR3
FQGSHVPNT

SEQ ID NO: 1979 - protein, 251 aa, Artificial Sequence
  Description of Artificial Sequence: Synthetic polypeptide
  XENP024289 1C11_H3.170_L3_scFv
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1980 - protein, 117 aa, Artificial Sequence
  Description of Artificial Sequence: Synthetic polypeptide
  VH of XENP024289
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSS

SEQ ID NO: 1981 - protein, 114 aa, Artificial Sequence; identical to SEQ ID NO: 649
  Description of Artificial Sequence: Synthetic polypeptide
  VL of XENP024289

SEQ ID NO: 1982 - protein, 5 aa, Artificial Sequence
  Description of Artificial Sequence: Synthetic peptide
  XENP024289 vhCDR1
HYGMN

SEQ ID NO: 1983 - protein, 17 aa, Artificial Sequence
  Description of Artificial Sequence: Synthetic peptide
  XENP024289 vhCDR2
WINTYTGEPTYADGFTG

SEQ ID NO: 1984 - protein, 8 aa, Artificial Sequence
  Description of Artificial Sequence: Synthetic peptide
  XENP024289 vhCDR3
DYYGSSPY

SEQ ID NO: 1985 - protein, 16 aa, Artificial Sequence
  Description of Artificial Sequence: Synthetic peptide
  XENP024289 vlCDR1
KSSQSIVHSNGNTYLE

SEQ ID NO: 1986 - protein, 7 aa, Artificial Sequence
  Description of Artificial Sequence: Synthetic peptide
  XENP024289 vlCDR2
KVSNRFS

SEQ ID NO: 1987 - protein, 9 aa, Artificial Sequence
  Description of Artificial Sequence: Synthetic peptide
  XENP024289 vlCDR3
FQGSHVPNT

SEQ ID NO: 1988 - protein, 251 aa, Artificial Sequence
  Description of Artificial Sequence: Synthetic polypeptide
  XENP024290 1C11_H3.171_L3_scFv
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1989 - protein, 117 aa, Artificial Sequence
  Description of Artificial Sequence: Synthetic polypeptide
  VH of XENP024290
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSS

SEQ ID NO: 1990 - protein, 114 aa, Artificial Sequence; identical to SEQ ID NO: 649
  Description of Artificial Sequence: Synthetic polypeptide
  VL of XENP024290

SEQ ID NO: 1991 - protein, 5 aa, Artificial Sequence
  Description of Artificial Sequence: Synthetic peptide
  XENP024290 vhCDR1
HYGMN

SEQ ID NO: 1992 - protein, 17 aa, Artificial Sequence
  Description of Artificial Sequence: Synthetic peptide
  XENP024290 vhCDR2
WINTYTGEPTYADGFTG

SEQ ID NO: 1993 - protein, 8 aa, Artificial Sequence
  Description of Artificial Sequence: Synthetic peptide
  XENP024290 vhCDR3
DYYGSSPY

SEQ ID NO: 1994 - protein, 16 aa, Artificial Sequence
  Description of Artificial Sequence: Synthetic peptide
  XENP024290 vlCDR1
KSSQSIVHSNGNTYLE

SEQ ID NO: 1995 - protein, 7 aa, Artificial Sequence
  Description of Artificial Sequence: Synthetic peptide
  XENP024290 vlCDR2
KVSNRFS

SEQ ID NO: 1996 - protein, 9 aa, Artificial Sequence
  Description of Artificial Sequence: Synthetic peptide
  XENP024290 vlCDR3
FQGSHVPNT

SEQ ID NO: 1997 - protein, 251 aa, Artificial Sequence
  Description of Artificial Sequence: Synthetic polypeptide
  XENP024291 1C11_H3.172_L3_scFv
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 1998 - protein, 117 aa, Artificial Sequence
  Description of Artificial Sequence: Synthetic polypeptide
  VH of XENP024291
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSS

SEQ ID NO: 1999 - protein, 114 aa, Artificial Sequence; identical to SEQ ID NO: 649
  Description of Artificial Sequence: Synthetic polypeptide
  VL of XENP024291

SEQ ID NO: 2000 - protein, 5 aa, Artificial Sequence
  Description of Artificial Sequence: Synthetic peptide
  XENP024291 vhCDR1
HYGMN

SEQ ID NO: 2001 - protein, 17 aa, Artificial Sequence
  Description of Artificial Sequence: Synthetic peptide
  XENP024291 vhCDR2
WINTYTGEPTYADGFTG

SEQ ID NO: 2002 - protein, 8 aa, Artificial Sequence
  Description of Artificial Sequence: Synthetic peptide
  XENP024291 vhCDR3
DYYGSSPY

SEQ ID NO: 2003 - protein, 16 aa, Artificial Sequence
  Description of Artificial Sequence: Synthetic peptide
  XENP024291 vlCDR1
KSSQSIVHSNGNTYLE

SEQ ID NO: 2004 - protein, 7 aa, Artificial Sequence
  Description of Artificial Sequence: Synthetic peptide
  XENP024291 vlCDR2
KVSNRFS

SEQ ID NO: 2005 - protein, 9 aa, Artificial Sequence
  Description of Artificial Sequence: Synthetic peptide
  XENP024291 vlCDR3
FQGSHVPNT

SEQ ID NO: 2006 - protein, 251 aa, Artificial Sequence
  Description of Artificial Sequence: Synthetic polypeptide
  XENP024292 1C11_H3.173_L3_scFv
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2007 - protein, 117 aa, Artificial Sequence
  Description of Artificial Sequence: Synthetic polypeptide
  VH of XENP024292
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSS

SEQ ID NO: 2008 - protein, 114 aa, Artificial Sequence; identical to SEQ ID NO: 649
  Description of Artificial Sequence: Synthetic polypeptide
  VL of XENP024292

SEQ ID NO: 2009 - protein, 5 aa, Artificial Sequence
  Description of Artificial Sequence: Synthetic peptide
  XENP024292 vhCDR1
HYGMN

SEQ ID NO: 2010 - protein, 17 aa, Artificial Sequence
  Description of Artificial Sequence: Synthetic peptide
  XENP024292 vhCDR2
WINTYTGEPTYADGFTG

SEQ ID NO: 2011 - protein, 8 aa, Artificial Sequence
  Description of Artificial Sequence: Synthetic peptide
  XENP024292 vhCDR3
DYYGSSPY

SEQ ID NO: 2012 - protein, 16 aa, Artificial Sequence
  Description of Artificial Sequence: Synthetic peptide
  XENP024292 vlCDR1
KSSQSIVHSNGNTYLE

SEQ ID NO: 2013 - protein, 7 aa, Artificial Sequence
  Description of Artificial Sequence: Synthetic peptide
  XENP024292 vlCDR2
KVSNRFS

SEQ ID NO: 2014 - protein, 9 aa, Artificial Sequence
  Description of Artificial Sequence: Synthetic peptide
  XENP024292 vlCDR3
FQGSHVPNT

SEQ ID NO: 2015 - protein, 251 aa, Artificial Sequence
  Description of Artificial Sequence: Synthetic polypeptide
  XENP024293 1C11_H3.174_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2016 - protein, 117 aa, Artificial Sequence
  Description of Artificial Sequence: Synthetic polypeptide
  VH of XENP024293
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSS

SEQ ID NO: 2017 - protein, 114 aa, Artificial Sequence; identical to SEQ ID NO: 649
  Description of Artificial Sequence: Synthetic polypeptide
  VL of XENP024293

SEQ ID NO: 2018 - protein, 5 aa, Artificial Sequence
  Description of Artificial Sequence: Synthetic peptide
  XENP024293 vhCDR1
HYGMN

SEQ ID NO: 2019 - protein, 17 aa, Artificial Sequence
  Description of Artificial Sequence: Synthetic peptide
  XENP024293 vhCDR2
WINTYTGEPTYADGFTG

SEQ ID NO: 2020 - protein, 8 aa, Artificial Sequence
  Description of Artificial Sequence: Synthetic peptide
  XENP024293 vhCDR3
DYYGSSPY

SEQ ID NO: 2021 - protein, 16 aa, Artificial Sequence
  Description of Artificial Sequence: Synthetic peptide
  XENP024293 vlCDR1
KSSQSIVHSNGNTYLE

SEQ ID NO: 2022 - protein, 7 aa, Artificial Sequence
  Description of Artificial Sequence: Synthetic peptide
  XENP024293 vlCDR2
KVSNRFS

SEQ ID NO: 2023 - protein, 9 aa, Artificial Sequence
  Description of Artificial Sequence: Synthetic peptide
  XENP024293 vlCDR3
FQGSHVPNT

SEQ ID NO: 2024 - protein, 251 aa, Artificial Sequence
  Description of Artificial Sequence: Synthetic polypeptide
  XENP024372 1C11_H3_L3.86_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 2025 - protein, 117 aa, Artificial Sequence; identical to SEQ ID NO: 32
  Description of Artificial Sequence: Synthetic polypeptide
  VH of XENP024372

SEQ ID NO: 2026 - protein, 114 aa, Artificial Sequence
  Description of Artificial Sequence: Synthetic polypeptide
  VL of XENP024372
DVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 2027 - protein, 5 aa, Artificial Sequence
  Description of Artificial Sequence: Synthetic peptide
  XENP024372 vhCDR1
HYGMN

SEQ ID NO: 2028 - protein, 17 aa, Artificial Sequence
  Description of Artificial Sequence: Synthetic peptide
  XENP024372 vhCDR2
WINTYTGEPTYADGFTG

SEQ ID NO: 2029 - protein, 8 aa, Artificial Sequence
  Description of Artificial Sequence: Synthetic peptide
  XENP024372 vhCDR3
DYYGSSPY

SEQ ID NO: 2030 - protein, 16 aa, Artificial Sequence
  Description of Artificial Sequence: Synthetic peptide
  XENP024372 vlCDR1
KSSQSIVHSNGNTYLE

SEQ ID NO: 2031 - protein, 7 aa, Artificial Sequence
  Description of Artificial Sequence: Synthetic peptide
  XENP024372 vlCDR2
KVSNRFT

SEQ ID NO: 2032 - protein, 9 aa, Artificial Sequence
  Description of Artificial Sequence: Synthetic peptide
  XENP024372 vlCDR3
FQGSHVPNT

SEQ ID NO: 2033 - protein, 251 aa, Artificial Sequence
  Description of Artificial Sequence: Synthetic polypeptide
  XENP024373 1C11_H3_L3.87_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 2034 - protein, 117 aa, Artificial Sequence; identical to SEQ ID NO: 32
  Description of Artificial Sequence: Synthetic polypeptide
  VH of XENP024373

SEQ ID NO: 2035 - protein, 114 aa, Artificial Sequence
  Description of Artificial Sequence: Synthetic polypeptide
  VL of XENP024373
DVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 2036 - protein, 5 aa, Artificial Sequence
  Description of Artificial Sequence: Synthetic peptide
  XENP024373 vhCDR1
HYGMN

SEQ ID NO: 2037 - protein, 17 aa, Artificial Sequence
  Description of Artificial Sequence: Synthetic peptide
  XENP024373 vhCDR2
WINTYTGEPTYADGFTG

SEQ ID NO: 2038 - protein, 8 aa, Artificial Sequence
  Description of Artificial Sequence: Synthetic peptide
  XENP024373 vhCDR3
DYYGSSPY

SEQ ID NO: 2039 - protein, 16 aa, Artificial Sequence
  Description of Artificial Sequence: Synthetic peptide
  XENP024373 vlCDR1
KASQSIVHSNGNTYLE

SEQ ID NO: 2040 - protein, 7 aa, Artificial Sequence
  Description of Artificial Sequence: Synthetic peptide
  XENP024373 vlCDR2
KVSNRFS

SEQ ID NO: 2041 - protein, 9 aa, Artificial Sequence
  Description of Artificial Sequence: Synthetic peptide
  XENP024373 vlCDR3
FQGSHVPNT

SEQ ID NO: 2042 - protein, 251 aa, Artificial Sequence
  Description of Artificial Sequence: Synthetic polypeptide
  XENP024374 1C11_H3_L3.90_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2043 - protein, 117 aa, Artificial Sequence; identical to SEQ ID NO: 32
  Description of Artificial Sequence: Synthetic polypeptide
  VH of XENP024374

SEQ ID NO: 2044 - protein, 114 aa, Artificial Sequence
  Description of Artificial Sequence: Synthetic polypeptide
  VL of XENP024374
DVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2045 - protein, 5 aa, Artificial Sequence
  Description of Artificial Sequence: Synthetic peptide
  XENP024374 vhCDR1
HYGMN

SEQ ID NO: 2046 - protein, 17 aa, Artificial Sequence
  Description of Artificial Sequence: Synthetic peptide
  XENP024374 vhCDR2
WINTYTGEPTYADGFTG

SEQ ID NO: 2047 - protein, 8 aa, Artificial Sequence
  Description of Artificial Sequence: Synthetic peptide
  XENP024374 vhCDR3
DYYGSSPY

SEQ ID NO: 2048 - protein, 16 aa, Artificial Sequence
  Description of Artificial Sequence: Synthetic peptide
  XENP024374 vlCDR1
KASQSIVHSNGNTYLE

SEQ ID NO: 2049 - protein, 7 aa, Artificial Sequence
  Description of Artificial Sequence: Synthetic peptide
  XENP024374 vlCDR2
KVSNRFS

SEQ ID NO: 2050 - protein, 9 aa, Artificial Sequence
  Description of Artificial Sequence: Synthetic peptide
  XENP024374 vlCDR3
FQGSHVPNT

SEQ ID NO: 2051 - protein, 251 aa, Artificial Sequence
  Description of Artificial Sequence: Synthetic polypeptide
  XENP024375 1C11_H3_L3.92_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 2052 - protein, 117 aa, Artificial Sequence; identical to SEQ ID NO: 32
  Description of Artificial Sequence: Synthetic polypeptide
  VH of XENP024375

SEQ ID NO: 2053 - protein, 114 aa, Artificial Sequence
  Description of Artificial Sequence: Synthetic polypeptide
  VL of XENP024375
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 2054 - protein, 5 aa, Artificial Sequence
  Description of Artificial Sequence: Synthetic peptide
  XENP024375 vhCDR1
HYGMN

SEQ ID NO: 2055 - protein, 17 aa, Artificial Sequence
  Description of Artificial Sequence: Synthetic peptide
  XENP024375 vhCDR2
WINTYTGEPTYADGFTG

SEQ ID NO: 2056 - protein, 8 aa, Artificial Sequence
  Description of Artificial Sequence: Synthetic peptide
  XENP024375 vhCDR3
DYYGSSPY

SEQ ID NO: 2057 - protein, 16 aa, Artificial Sequence
  Description of Artificial Sequence: Synthetic peptide
  XENP024375 vlCDR1
KASQSIVHSNGNTYLE

SEQ ID NO: 2058 - protein, 7 aa, Artificial Sequence
  Description of Artificial Sequence: Synthetic peptide
  XENP024375 vlCDR2
KVSNRFT

SEQ ID NO: 2059 - protein, 9 aa, Artificial Sequence
  Description of Artificial Sequence: Synthetic peptide
  XENP024375 vlCDR3
FQGSHVPNT

SEQ ID NO: 2060 - protein, 251 aa, Artificial Sequence
  Description of Artificial Sequence: Synthetic polypeptide
  XENP024376 1C11_H3_L3.94_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 2061 - protein, 117 aa, Artificial Sequence; identical to SEQ ID NO: 32
  Description of Artificial Sequence: Synthetic polypeptide
  VH of XENP024376

SEQ ID NO: 2062 - protein, 114 aa, Artificial Sequence
  Description of Artificial Sequence: Synthetic polypeptide
  VL of XENP024376
DILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 2063 - protein, 5 aa, Artificial Sequence
  Description of Artificial Sequence: Synthetic peptide
  XENP024376 vhCDR1
HYGMN

SEQ ID NO: 2064 - protein, 17 aa, Artificial Sequence
  Description of Artificial Sequence: Synthetic peptide
  XENP024376 vhCDR2
WINTYTGEPTYADGFTG

SEQ ID NO: 2065 - protein, 8 aa, Artificial Sequence
  Description of Artificial Sequence: Synthetic peptide
  XENP024376 vhCDR3
DYYGSSPY

SEQ ID NO: 2066 - protein, 16 aa, Artificial Sequence
  Description of Artificial Sequence: Synthetic peptide
  XENP024376 vlCDR1
KSSQSIVHSNGNTYLE

SEQ ID NO: 2067 - protein, 7 aa, Artificial Sequence
  Description of Artificial Sequence: Synthetic peptide
  XENP024376 vlCDR2
KVSNRFT

SEQ ID NO: 2068 - protein, 9 aa, Artificial Sequence
  Description of Artificial Sequence: Synthetic peptide
  XENP024376 vlCDR3
FQGSHVPNT

SEQ ID NO: 2069 - protein, 251 aa, Artificial Sequence
  Description of Artificial Sequence: Synthetic polypeptide
  XENP024377 1C11_H3_L3.96_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 2070 - protein, 117 aa, Artificial Sequence; identical to SEQ ID NO: 32
  Description of Artificial Sequence: Synthetic polypeptide
  VH of XENP024377

SEQ ID NO: 2071 - protein, 114 aa, Artificial Sequence
  Description of Artificial Sequence: Synthetic polypeptide
  VL of XENP024377
DIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 2072 - protein, 5 aa, Artificial Sequence
  Description of Artificial Sequence: Synthetic peptide
  XENP024377 vhCDR1
HYGMN

SEQ ID NO: 2073 - protein, 17 aa, Artificial Sequence
  Description of Artificial Sequence: Synthetic peptide
  XENP024377 vhCDR2
WINTYTGEPTYADGFTG

SEQ ID NO: 2074 - protein, 8 aa, Artificial Sequence
  Description of Artificial Sequence: Synthetic peptide
  XENP024377 vhCDR3
DYYGSSPY

SEQ ID NO: 2075 - protein, 16 aa, Artificial Sequence
  Description of Artificial Sequence: Synthetic peptide
  XENP024377 vlCDR1
KASQSIVHSNGNTYLE

SEQ ID NO: 2076 - protein, 7 aa, Artificial Sequence
  Description of Artificial Sequence: Synthetic peptide
  XENP024377 vlCDR2
KVSNRFT

SEQ ID NO: 2077 - protein, 9 aa, Artificial Sequence
  Description of Artificial Sequence: Synthetic peptide
  XENP024377 vlCDR3
FQGSHVPNT

SEQ ID NO: 2078 - protein, 251 aa, Artificial Sequence
  Description of Artificial Sequence: Synthetic polypeptide
  XENP024378 1C11_H3_L3.105_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2079 - protein, 117 aa, Artificial Sequence; identical to SEQ ID NO: 32
  Description of Artificial Sequence: Synthetic polypeptide
  VH of XENP024378

SEQ ID NO: 2080 - protein, 114 aa, Artificial Sequence
  Description of Artificial Sequence: Synthetic polypeptide
  VL of XENP024378
DVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2081 - protein, 5 aa, Artificial Sequence
  Description of Artificial Sequence: Synthetic peptide
  XENP024378 vhCDR1
HYGMN

SEQ ID NO: 2082 - protein, 17 aa, Artificial Sequence
  Description of Artificial Sequence: Synthetic peptide
  XENP024378 vhCDR2
WINTYTGEPTYADGFTG

SEQ ID NO: 2083 - protein, 8 aa, Artificial Sequence
  Description of Artificial Sequence: Synthetic peptide
  XENP024378 vhCDR3
DYYGSSPY

SEQ ID NO: 2084 - protein, 16 aa, Artificial Sequence
  Description of Artificial Sequence: Synthetic peptide
  XENP024378 vlCDR1
KSSQSIVHSNGNTYLE

SEQ ID NO: 2085 - protein, 7 aa, Artificial Sequence
  Description of Artificial Sequence: Synthetic peptide
  XENP024378 vlCDR2
KVSNRFS

SEQ ID NO: 2086 - protein, 9 aa, Artificial Sequence
  Description of Artificial Sequence: Synthetic peptide
  XENP024378 vlCDR3
FQGSHVPNT

SEQ ID NO: 2087 - protein, 251 aa, Artificial Sequence
  Description of Artificial Sequence: Synthetic polypeptide
  XENP024379 1C11_H3_L3.129_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 2088 - protein, 117 aa, Artificial Sequence; identical to SEQ ID NO: 32
  Description of Artificial Sequence: Synthetic polypeptide
  VH of XENP024379

SEQ ID NO: 2089 - protein, 114 aa, Artificial Sequence
  Description of Artificial Sequence: Synthetic polypeptide
  VL of XENP024379
DVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 2090 - protein, 5 aa, Artificial Sequence
  Description of Artificial Sequence: Synthetic peptide
  XENP024379 vhCDR1
HYGMN

SEQ ID NO: 2091 - protein, 17 aa, Artificial Sequence
  Description of Artificial Sequence: Synthetic peptide
  XENP024379 vhCDR2
WINTYTGEPTYADGFTG

SEQ ID NO: 2092 - protein, 8 aa, Artificial Sequence
  Description of Artificial Sequence: Synthetic peptide
  XENP024379 vhCDR3
DYYGSSPY

SEQ ID NO: 2093 - protein, 16 aa, Artificial Sequence
  Description of Artificial Sequence: Synthetic peptide
  XENP024379 vlCDR1
KSSQSIVHSNGNTYLE

SEQ ID NO: 2094 - protein, 7 aa, Artificial Sequence
  Description of Artificial Sequence: Synthetic peptide
  XENP024379 vlCDR2
KVSNRFS

SEQ ID NO: 2095 - protein, 9 aa, Artificial Sequence
  Description of Artificial Sequence: Synthetic peptide
  XENP024379 vlCDR3
HQGSHVPNT

SEQ ID NO: 2096 - protein, 251 aa, Artificial Sequence
  Description of Artificial Sequence: Synthetic polypeptide
  XENP024380 1C11_H3.176_L3.92_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 2097 - protein, 117 aa, Artificial Sequence
  Description of Artificial Sequence: Synthetic polypeptide
  VH of XENP024380
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSS

SEQ ID NO: 2098 - protein, 114 aa, Artificial Sequence; identical to SEQ ID NO: 2053
  Description of Artificial Sequence: Synthetic polypeptide
  VL of XENP024380

SEQ ID NO: 2099 - protein, 5 aa, Artificial Sequence
  Description of Artificial Sequence: Synthetic peptide
  XENP024380 vhCDR1
HYGMN

SEQ ID NO: 2100 - protein, 17 aa, Artificial Sequence
  Description of Artificial Sequence: Synthetic peptide
  XENP024380 vhCDR2
WINTNTGEPTYADKFTG

SEQ ID NO: 2101 - protein, 8 aa, Artificial Sequence
  Description of Artificial Sequence: Synthetic peptide
  XENP024380 vhCDR3
DYYGSSPY

SEQ ID NO: 2102 - protein, 16 aa, Artificial Sequence
  Description of Artificial Sequence: Synthetic peptide
  XENP024380 vlCDR1
KASQSIVHSNGNTYLE

SEQ ID NO: 2103 - protein, 7 aa, Artificial Sequence
  Description of Artificial Sequence: Synthetic peptide
  XENP024380 vlCDR2
KVSNRFT

SEQ ID NO: 2104 - protein, 9 aa, Artificial Sequence
  Description of Artificial Sequence: Synthetic peptide
  XENP024380 vlCDR3
FQGSHVPNT

SEQ ID NO: 2105 - protein, 251 aa, Artificial Sequence
  Description of Artificial Sequence: Synthetic polypeptide
  XENP024381 1C11_H3.176_L3.94_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 2106 - protein, 117 aa, Artificial Sequence; identical to SEQ ID NO: 2097
  Description of Artificial Sequence: Synthetic polypeptide
  VH of XENP024381

SEQ ID NO: 2107 - protein, 114 aa, Artificial Sequence; identical to SEQ ID NO: 2062
  Description of Artificial Sequence: Synthetic polypeptide
  VL of XENP024381

SEQ ID NO: 2108 - protein, 5 aa, Artificial Sequence
  Description of Artificial Sequence: Synthetic peptide
  XENP024381 vhCDR1
HYGMN

SEQ ID NO: 2109 - protein, 17 aa, Artificial Sequence
  Description of Artificial Sequence: Synthetic peptide
  XENP024381 vhCDR2
WINTNTGEPTYADKFTG

SEQ ID NO: 2110 - protein, 8 aa, Artificial Sequence
  Description of Artificial Sequence: Synthetic peptide
  XENP024381 vhCDR3
DYYGSSPY

SEQ ID NO: 2111 - protein, 16 aa, Artificial Sequence
  Description of Artificial Sequence: Synthetic peptide
  XENP024381 vlCDR1
KSSQSIVHSNGNTYLE

SEQ ID NO: 2112 - protein, 7 aa, Artificial Sequence
  Description of Artificial Sequence: Synthetic peptide
  XENP024381 vlCDR2
KVSNRFT

SEQ ID NO: 2113 - protein, 9 aa, Artificial Sequence
  Description of Artificial Sequence: Synthetic peptide
  XENP024381 vlCDR3
FQGSHVPNT

SEQ ID NO: 2114 - protein, 251 aa, Artificial Sequence
  Description of Artificial Sequence: Synthetic polypeptide
  XENP024382 1C11_H3.176_L3.96_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 2115 - protein, 117 aa, Artificial Sequence; identical to SEQ ID NO: 2097
  Description of Artificial Sequence: Synthetic polypeptide
  VH of XENP024382

SEQ ID NO: 2116 - protein, 114 aa, Artificial Sequence; identical to SEQ ID NO: 2071
  Description of Artificial Sequence: Synthetic polypeptide
  VL of XENP024382

SEQ ID NO: 2117 - protein, 5 aa, Artificial Sequence
  Description of Artificial Sequence: Synthetic peptide
  XENP024382 vhCDR1
HYGMN

SEQ ID NO: 2118 - protein, 17 aa, Artificial Sequence
  Description of Artificial Sequence: Synthetic peptide
  XENP024382 vhCDR2
WINTNTGEPTYADKFTG

SEQ ID NO: 2119 - protein, 8 aa, Artificial Sequence
  Description of Artificial Sequence: Synthetic peptide
  XENP024382 vhCDR3
DYYGSSPY

SEQ ID NO: 2120 - protein, 16 aa, Artificial Sequence
  Description of Artificial Sequence: Synthetic peptide
  XENP024382 vlCDR1
KASQSIVHSNGNTYLE

SEQ ID NO: 2121 - protein, 7 aa, Artificial Sequence
  Description of Artificial Sequence: Synthetic peptide
  XENP024382 vlCDR2
KVSNRFT

SEQ ID NO: 2122 - protein, 9 aa, Artificial Sequence
  Description of Artificial Sequence: Synthetic peptide
  XENP024382 vlCDR3
FQGSHVPNT

SEQ ID NO: 2123 - protein, 251 aa, Artificial Sequence
  Description of Artificial Sequence: Synthetic polypeptide
  XENP024414 1C11_H3_L3.133_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2124 - protein, 117 aa, Artificial Sequence; identical to SEQ ID NO: 32
  Description of Artificial Sequence: Synthetic polypeptide
  VH of XENP024414

SEQ ID NO: 2125 - protein, 114 aa, Artificial Sequence
  Description of Artificial Sequence: Synthetic polypeptide
  VL of XENP024414
DVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2126 - protein, 5 aa, Artificial Sequence
  Description of Artificial Sequence: Synthetic peptide
  XENP024414 vhCDR1
HYGMN

SEQ ID NO: 2127 - protein, 17 aa, Artificial Sequence
  Description of Artificial Sequence: Synthetic peptide
  XENP024414 vhCDR2
WINTYTGEPTYADGFTG

SEQ ID NO: 2128 - protein, 8 aa, Artificial Sequence
  Description of Artificial Sequence: Synthetic peptide
  XENP024414 vhCDR3
DYYGSSPY

SEQ ID NO: 2129 - protein, 16 aa, Artificial Sequence
  Description of Artificial Sequence: Synthetic peptide
  XENP024414 vlCDR1
KASQSIVHSNGNTYLE

SEQ ID NO: 2130 - protein, 7 aa, Artificial Sequence
  Description of Artificial Sequence: Synthetic peptide
  XENP024414 vlCDR2
KVSNRFS

SEQ ID NO: 2131 - protein, 9 aa, Artificial Sequence
  Description of Artificial Sequence: Synthetic peptide
  XENP024414 vlCDR3
FQGSHVPNT

SEQ ID NO: 2132 - protein, 251 aa, Artificial Sequence
  Description of Artificial Sequence: Synthetic polypeptide
  XENP024415 1C11_H3_L3.134_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 2133 - protein, 117 aa, Artificial Sequence; identical to SEQ ID NO: 32
  Description of Artificial Sequence: Synthetic polypeptide
  VH of XENP024415

SEQ ID NO: 2134 - protein, 114 aa, Artificial Sequence
  Description of Artificial Sequence: Synthetic polypeptide
  VL of XENP024415
DVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 2135 - protein, 5 aa, Artificial Sequence
  Description of Artificial Sequence: Synthetic peptide
  XENP024415 vhCDR1
HYGMN

SEQ ID NO: 2136 - protein, 17 aa, Artificial Sequence
  Description of Artificial Sequence: Synthetic peptide
  XENP024415 vhCDR2
WINTYTGEPTYADGFTG

SEQ ID NO: 2137 - protein, 8 aa, Artificial Sequence
  Description of Artificial Sequence: Synthetic peptide
  XENP024415 vhCDR3
DYYGSSPY

SEQ ID NO: 2138 - protein, 16 aa, Artificial Sequence
  Description of Artificial Sequence: Synthetic peptide
  XENP024415 vlCDR1
KASQSIVHSNGNTYLE

SEQ ID NO: 2139 - protein, 7 aa, Artificial Sequence
  Description of Artificial Sequence: Synthetic peptide
  XENP024415 vlCDR2
KVSNRFS

SEQ ID NO: 2140 - protein, 9 aa, Artificial Sequence
  Description of Artificial Sequence: Synthetic peptide
  XENP024415 vlCDR3
FQGSHVPNT

SEQ ID NO: 2141 - protein, 251 aa, Artificial Sequence
  Description of Artificial Sequence: Synthetic polypeptide
  XENP024416 1C11_H3_L3.135_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 2142 - protein, 117 aa, Artificial Sequence; identical to SEQ ID NO: 32
  Description of Artificial Sequence: Synthetic polypeptide
  VH of XENP024416

SEQ ID NO: 2143 - protein, 114 aa, Artificial Sequence
  Description of Artificial Sequence: Synthetic polypeptide
  VL of XENP024416
DVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 2144 - protein, 5 aa, Artificial Sequence
  Description of Artificial Sequence: Synthetic peptide
  XENP024416 vhCDR1
HYGMN

SEQ ID NO: 2145 - protein, 17 aa, Artificial Sequence
  Description of Artificial Sequence: Synthetic peptide
  XENP024416 vhCDR2
WINTYTGEPTYADGFTG

SEQ ID NO: 2146 - protein, 8 aa, Artificial Sequence
  Description of Artificial Sequence: Synthetic peptide
  XENP024416 vhCDR3
DYYGSSPY

SEQ ID NO: 2147 - protein, 16 aa, Artificial Sequence
  Description of Artificial Sequence: Synthetic peptide
  XENP024416 vlCDR1
KASQSIVHSNGNTYLE

SEQ ID NO: 2148 - protein, 7 aa, Artificial Sequence
  Description of Artificial Sequence: Synthetic peptide
  XENP024416 vlCDR2
KVSNRFS

SEQ ID NO: 2149 - protein, 9 aa, Artificial Sequence
  Description of Artificial Sequence: Synthetic peptide
  XENP024416 vlCDR3
FQGSHVPNT

SEQ ID NO: 2150 - protein, 251 aa, Artificial Sequence
  Description of Artificial Sequence: Synthetic polypeptide
  XENP024417 1C11_H3_L3.136_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 2151 - protein, 117 aa, Artificial Sequence; identical to SEQ ID NO: 32
  Description of Artificial Sequence: Synthetic polypeptide
  VH of XENP024417

SEQ ID NO: 2152 - protein, 114 aa, Artificial Sequence
  Description of Artificial Sequence: Synthetic polypeptide
  VL of XENP024417
DVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 2153 - protein, 5 aa, Artificial Sequence
  Description of Artificial Sequence: Synthetic peptide
  XENP024417 vhCDR1
HYGMN

SEQ ID NO: 2154 - protein, 17 aa, Artificial Sequence
  Description of Artificial Sequence: Synthetic peptide
  XENP024417 vhCDR2
WINTYTGEPTYADGFTG

SEQ ID NO: 2155 - protein, 8 aa, Artificial Sequence
  Description of Artificial Sequence: Synthetic peptide
  XENP024417 vhCDR3
DYYGSSPY

SEQ ID NO: 2156 - protein, 16 aa, Artificial Sequence
  Description of Artificial Sequence: Synthetic peptide
  XENP024417 vlCDR1
KASQSIVHSNGNTYLE

SEQ ID NO: 2157 - protein, 7 aa, Artificial Sequence
  Description of Artificial Sequence: Synthetic peptide
  XENP024417 vlCDR2
KVSNRFS

SEQ ID NO: 2158 - protein, 9 aa, Artificial Sequence
  Description of Artificial Sequence: Synthetic peptide
  XENP024417 vlCDR3
FQGSHVPNT

SEQ ID NO: 2159 - protein, 251 aa, Artificial Sequence
  Description of Artificial Sequence: Synthetic polypeptide
  XENP024418 1C11_H3_L3.137_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2160 - protein, 117 aa, Artificial Sequence; identical to SEQ ID NO: 32
  Description of Artificial Sequence: Synthetic polypeptide
  VH of XENP024418

SEQ ID NO: 2161 - protein, 114 aa, Artificial Sequence
  Description of Artificial Sequence: Synthetic polypeptide
  VL of XENP024418
DVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 2162 - protein, 5 aa, Artificial Sequence
  Description of Artificial Sequence: Synthetic peptide
  XENP024418 vhCDR1
HYGMN

SEQ ID NO: 2163 - protein, 17 aa, Artificial Sequence
  Description of Artificial Sequence: Synthetic peptide
  XENP024418 vhCDR2
WINTYTGEPTYADGFTG

SEQ ID NO: 2164 - protein, 8 aa, Artificial Sequence
  Description of Artificial Sequence: Synthetic peptide
  XENP024418 vhCDR3
DYYGSSPY

SEQ ID NO: 2165 - protein, 16 aa, Artificial Sequence
  Description of Artificial Sequence: Synthetic peptide
  XENP024418 vlCDR1
KASQSIVHSNGNTYLE

SEQ ID NO: 2166 - protein, 7 aa, Artificial Sequence
  Description of Artificial Sequence: Synthetic peptide
  XENP024418 vlCDR2
KVSNRFS

SEQ ID NO: 2167 - protein, 9 aa, Artificial Sequence
  Description of Artificial Sequence: Synthetic peptide
  XENP024418 vlCDR3
FQGSHVPNT

SEQ ID NO: 2168 - protein, 251 aa, Artificial Sequence
  Description of Artificial Sequence: Synthetic polypeptide
  XENP024419 1C11_H3_L3.138_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 2169 - protein, 117 aa, Artificial Sequence; identical to SEQ ID NO: 32
  Description of Artificial Sequence: Synthetic polypeptide
  VH of XENP024419

SEQ ID NO: 2170 - protein, 114 aa, Artificial Sequence
  Description of Artificial Sequence: Synthetic polypeptide
  VL of XENP024419
DVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 2171 - protein, 5 aa, Artificial Sequence
  Description of Artificial Sequence: Synthetic peptide
  XENP024419 vhCDR1
HYGMN

SEQ ID NO: 2172 - protein, 17 aa, Artificial Sequence
  Description of Artificial Sequence: Synthetic peptide
  XENP024419 vhCDR2
WINTYTGEPTYADGFTG

SEQ ID NO: 2173 - protein, 8 aa, Artificial Sequence
  Description of Artificial Sequence: Synthetic peptide
  XENP024419 vhCDR3
DYYGSSPY

SEQ ID NO: 2174 - protein, 16 aa, Artificial Sequence
  Description of Artificial Sequence: Synthetic peptide
  XENP024419 vlCDR1
KASQSIVHSNGNTYLE

SEQ ID NO: 2175 - protein, 7 aa, Artificial Sequence
  Description of Artificial Sequence: Synthetic peptide
  XENP024419 vlCDR2
KVSNRFS

SEQ ID NO: 2176 - protein, 9 aa, Artificial Sequence
  Description of Artificial Sequence: Synthetic peptide
  XENP024419 vlCDR3
FQGSHVPNT

SEQ ID NO: 2177 - protein, 251 aa, Artificial Sequence
  Description of Artificial Sequence: Synthetic polypeptide
  XENP024420 1C11_H3_L3.139_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 2178 - protein, 117 aa, Artificial Sequence; identical to SEQ ID NO: 32
  Description of Artificial Sequence: Synthetic polypeptide
  VH of XENP024420

SEQ ID NO: 2179 - protein, 114 aa, Artificial Sequence
  Description of Artificial Sequence: Synthetic polypeptide
  VL of XENP024420
DVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 2180 - protein, 5 aa, Artificial Sequence
  Description of Artificial Sequence: Synthetic peptide
  XENP024420 vhCDR1
HYGMN

SEQ ID NO: 2181 - protein, 17 aa, Artificial Sequence
  Description of Artificial Sequence: Synthetic peptide
  XENP024420 vhCDR2
WINTYTGEPTYADGFTG

SEQ ID NO: 2182 - protein, 8 aa, Artificial Sequence
  Description of Artificial Sequence: Synthetic peptide
  XENP024420 vhCDR3
DYYGSSPY

SEQ ID NO: 2183 - protein, 16 aa, Artificial Sequence
  Description of Artificial Sequence: Synthetic peptide
  XENP024420 vlCDR1
KASQSIVHSNGNTYLE

SEQ ID NO: 2184 - protein, 7 aa, Artificial Sequence
  Description of Artificial Sequence: Synthetic peptide
  XENP024420 vlCDR2
KVSNRFS

SEQ ID NO: 2185 - protein, 9 aa, Artificial Sequence
  Description of Artificial Sequence: Synthetic peptide
  XENP024420 vlCDR3
FQGSHVPNT

SEQ ID NO: 2186 - protein, 251 aa, Artificial Sequence
  Description of Artificial Sequence: Synthetic polypeptide
  XENP024421 1C11_H3_L3.140_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 2187 - protein, 117 aa, Artificial Sequence; identical to SEQ ID NO: 32
  Description of Artificial Sequence: Synthetic polypeptide
  VH of XENP024421

SEQ ID NO: 2188 - protein, 114 aa, Artificial Sequence
  Description of Artificial Sequence: Synthetic polypeptide
  VL of XENP024421
DIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 2189 - protein, 5 aa, Artificial Sequence
  Description of Artificial Sequence: Synthetic peptide
  XENP024421 vhCDR1
HYGMN

SEQ ID NO: 2190 - protein, 17 aa, Artificial Sequence
  Description of Artificial Sequence: Synthetic peptide
  XENP024421 vhCDR2
WINTYTGEPTYADGFTG

SEQ ID NO: 2191 - protein, 8 aa, Artificial Sequence
  Description of Artificial Sequence: Synthetic peptide
  XENP024421 vhCDR3
DYYGSSPY

SEQ ID NO: 2192 - protein, 16 aa, Artificial Sequence
  Description of Artificial Sequence: Synthetic peptide
  XENP024421 vlCDR1
KASQSIVHSNGNTYLE

SEQ ID NO: 2193 - protein, 7 aa, Artificial Sequence
  Description of Artificial Sequence: Synthetic peptide
  XENP024421 vlCDR2
KVSNRFS

SEQ ID NO: 2194 - protein, 9 aa, Artificial Sequence
  Description of Artificial Sequence: Synthetic peptide
  XENP024421 vlCDR3
FQGSHVPNT

SEQ ID NO: 2195 - protein, 251 aa, Artificial Sequence
  Description of Artificial Sequence: Synthetic polypeptide
  XENP024422 1C11_H3_L3.141_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 2196 - protein, 117 aa, Artificial Sequence; identical to SEQ ID NO: 32
  Description of Artificial Sequence: Synthetic polypeptide
  VH of XENP024422

SEQ ID NO: 2197 - protein, 114 aa, Artificial Sequence
  Description of Artificial Sequence: Synthetic polypeptide
  VL of XENP024422
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 2198 - protein, 5 aa, Artificial Sequence
  Description of Artificial Sequence: Synthetic peptide
  XENP024422 vhCDR1
HYGMN

SEQ ID NO: 2199 - protein, 17 aa, Artificial Sequence
  Description of Artificial Sequence: Synthetic peptide
  XENP024422 vhCDR2
WINTYTGEPTYADGFTG

SEQ ID NO: 2200 - protein, 8 aa, Artificial Sequence
  Description of Artificial Sequence: Synthetic peptide
  XENP024422 vhCDR3
DYYGSSPY

SEQ ID NO: 2201 - protein, 16 aa, Artificial Sequence
  Description of Artificial Sequence: Synthetic peptide
  XENP024422 vlCDR1
KASQSIVHSNGNTYLE

SEQ ID NO: 2202 - protein, 7 aa, Artificial Sequence
  Description of Artificial Sequence: Synthetic peptide
  XENP024422 vlCDR2
KVSNRFS

SEQ ID NO: 2203 - protein, 9 aa, Artificial Sequence
  Description of Artificial Sequence: Synthetic peptide
  XENP024422 vlCDR3
FQGSHVPNT

SEQ ID NO: 2204 - protein, 251 aa, Artificial Sequence
  Description of Artificial Sequence: Synthetic polypeptide
  XENP024423 1C11_H3_L3.142_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 2205 - protein, 117 aa, Artificial Sequence; identical to SEQ ID NO: 32
  Description of Artificial Sequence: Synthetic polypeptide
  VH of XENP024423

SEQ ID NO: 2206 - protein, 114 aa, Artificial Sequence
  Description of Artificial Sequence: Synthetic polypeptide
  VL of XENP024423
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 2207 - protein, 5 aa, Artificial Sequence
  Description of Artificial Sequence: Synthetic peptide
  XENP024423 vhCDR1
HYGMN

SEQ ID NO: 2208 - protein, 17 aa, Artificial Sequence
  Description of Artificial Sequence: Synthetic peptide
  XENP024423 vhCDR2
WINTYTGEPTYADGFTG

SEQ ID NO: 2209 - protein, 8 aa, Artificial Sequence
  Description of Artificial Sequence: Synthetic peptide
  XENP024423 vhCDR3
DYYGSSPY

SEQ ID NO: 2210 - protein, 16 aa, Artificial Sequence
  Description of Artificial Sequence: Synthetic peptide
  XENP024423 vlCDR1
KASQSIVHSNGNTYLE

SEQ ID NO: 2211 - protein, 7 aa, Artificial Sequence
  Description of Artificial Sequence: Synthetic peptide
  XENP024423 vlCDR2
KVSNRFS

SEQ ID NO: 2212 - protein, 9 aa, Artificial Sequence
  Description of Artificial Sequence: Synthetic peptide
  XENP024423 vlCDR3
FQGSHVPNT

SEQ ID NO: 2213 - protein, 251 aa, Artificial Sequence
  Description of Artificial Sequence: Synthetic polypeptide
  XENP024424 1C11_H3.176_L3_scFv
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2214 - protein, 117 aa, Artificial Sequence
  Description of Artificial Sequence: Synthetic polypeptide
  VH of XENP024424
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSS

SEQ ID NO: 2215 - protein, 114 aa, Artificial Sequence; identical to SEQ ID NO: 649
  Description of Artificial Sequence: Synthetic polypeptide
  VL of XENP024424

SEQ ID NO: 2216 - protein, 5 aa, Artificial Sequence
  Description of Artificial Sequence: Synthetic peptide
  XENP024424 vhCDR1
HYGMN

SEQ ID NO: 2217 - protein, 17 aa, Artificial Sequence
  Description of Artificial Sequence: Synthetic peptide
  XENP024424 vhCDR2
WINTYTGEPTYAPGFKG

SEQ ID NO: 2218 - protein, 8 aa, Artificial Sequence
  Description of Artificial Sequence: Synthetic peptide
  XENP024424 vhCDR3
DYYGSSPY

SEQ ID NO: 2219 - protein, 16 aa, Artificial Sequence
  Description of Artificial Sequence: Synthetic peptide
  XENP024424 vlCDR1
KSSQSIVHSNGNTYLE

SEQ ID NO: 2220 - protein, 7 aa, Artificial Sequence
  Description of Artificial Sequence: Synthetic peptide
  XENP024424 vlCDR2
KVSNRFS

SEQ ID NO: 2221 - protein, 9 aa, Artificial Sequence
  Description of Artificial Sequence: Synthetic peptide
  XENP024424 vlCDR3
FQGSHVPNT

SEQ ID NO: 2222 - protein, 251 aa, Artificial Sequence
  Description of Artificial Sequence: Synthetic polypeptide
  XENP024425 1C11_H3.177_L3_scFv
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2223 - protein, 117 aa, Artificial Sequence
  Description of Artificial Sequence: Synthetic polypeptide
  VH of XENP024425
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSS

SEQ ID NO: 2224 - protein, 114 aa, Artificial Sequence; identical to SEQ ID NO: 649
  Description of Artificial Sequence: Synthetic polypeptide
  VL of XENP024425

SEQ ID NO: 2225 - protein, 5 aa, Artificial Sequence
  Description of Artificial Sequence: Synthetic peptide
  XENP024425 vhCDR1
HYGMN

SEQ ID NO: 2226 - protein, 17 aa, Artificial Sequence
  Description of Artificial Sequence: Synthetic peptide
  XENP024425 vhCDR2
WINTYTGEPTYAPKFTG

SEQ ID NO: 2227 - protein, 8 aa, Artificial Sequence
  Description of Artificial Sequence: Synthetic peptide
  XENP024425 vhCDR3
DYYGSSPY

SEQ ID NO: 2228 - protein, 16 aa, Artificial Sequence
  Description of Artificial Sequence: Synthetic peptide
  XENP024425 vlCDR1
KSSQSIVHSNGNTYLE

SEQ ID NO: 2229 - protein, 7 aa, Artificial Sequence
  Description of Artificial Sequence: Synthetic peptide
  XENP024425 vlCDR2
KVSNRFS

SEQ ID NO: 2230 - protein, 9 aa, Artificial Sequence
  Description of Artificial Sequence: Synthetic peptide
  XENP024425 vlCDR3
FQGSHVPNT

SEQ ID NO: 2231 - protein, 251 aa, Artificial Sequence
  Description of Artificial Sequence: Synthetic polypeptide
  XENP024426 1C11_H3.178_L3_scFv
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2232 - protein, 117 aa, Artificial Sequence
  Description of Artificial Sequence: Synthetic polypeptide
  VH of XENP024426
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSS

SEQ ID NO: 2233 - protein, 114 aa, Artificial Sequence; identical to SEQ ID NO: 649
  Description of Artificial Sequence: Synthetic polypeptide
  VL of XENP024426

SEQ ID NO: 2234 - protein, 5 aa, Artificial Sequence
  Description of Artificial Sequence: Synthetic peptide
  XENP024426 vhCDR1
HYGMN

SEQ ID NO: 2235 - protein, 17 aa, Artificial Sequence
  Description of Artificial Sequence: Synthetic peptide
  XENP024426 vhCDR2
WINTYTGEPTYAPGFKE

SEQ ID NO: 2236 - protein, 8 aa, Artificial Sequence
  Description of Artificial Sequence: Synthetic peptide
  XENP024426 vhCDR3
DYYGSSPY

SEQ ID NO: 2237 - protein, 16 aa, Artificial Sequence
  Description of Artificial Sequence: Synthetic peptide
  XENP024426 vlCDR1
KSSQSIVHSNGNTYLE

SEQ ID NO: 2238 - protein, 7 aa, Artificial Sequence
  Description of Artificial Sequence: Synthetic peptide
  XENP024426 vlCDR2
KVSNRFS

SEQ ID NO: 2239 - protein, 9 aa, Artificial Sequence
  Description of Artificial Sequence: Synthetic peptide
  XENP024426 vlCDR3
FQGSHVPNT

SEQ ID NO: 2240 - protein, 251 aa, Artificial Sequence
  Description of Artificial Sequence: Synthetic polypeptide
  XENP024427 1C11_H3.179_L3_scFv
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2241 - protein, 117 aa, Artificial Sequence
  Description of Artificial Sequence: Synthetic polypeptide
  VH of XENP024427
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSS

SEQ ID NO: 2242 - protein, 114 aa, Artificial Sequence; identical to SEQ ID NO: 649
  Description of Artificial Sequence: Synthetic polypeptide
  VL of XENP024427

SEQ ID NO: 2243 - protein, 5 aa, Artificial Sequence
  Description of Artificial Sequence: Synthetic peptide
  XENP024427 vhCDR1
HYGMN

SEQ ID NO: 2244 - protein, 17 aa, Artificial Sequence
  Description of Artificial Sequence: Synthetic peptide
  XENP024427 vhCDR2
WINTYTGEPTYAPKFTE

SEQ ID NO: 2245 - protein, 8 aa, Artificial Sequence
  Description of Artificial Sequence: Synthetic peptide
  XENP024427 vhCDR3
DYYGSSPY

SEQ ID NO: 2246 - protein, 16 aa, Artificial Sequence
  Description of Artificial Sequence: Synthetic peptide
  XENP024427 vlCDR1
KSSQSIVHSNGNTYLE

SEQ ID NO: 2247 - protein, 7 aa, Artificial Sequence
  Description of Artificial Sequence: Synthetic peptide
  XENP024427 vlCDR2
KVSNRFS

SEQ ID NO: 2248 - protein, 9 aa, Artificial Sequence
  Description of Artificial Sequence: Synthetic peptide
  XENP024427 vlCDR3
FQGSHVPNT

SEQ ID NO: 2249 - protein, 251 aa, Artificial Sequence
  Description of Artificial Sequence: Synthetic polypeptide
  XENP024428 1C11_H3.180_L3_scFv
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2250 - protein, 117 aa, Artificial Sequence
  Description of Artificial Sequence: Synthetic polypeptide
  VH of XENP024428
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSS

SEQ ID NO: 2251 - protein, 114 aa, Artificial Sequence; identical to SEQ ID NO: 649
  Description of Artificial Sequence: Synthetic polypeptide
  VL of XENP024428

SEQ ID NO: 2252 - protein, 5 aa, Artificial Sequence
  Description of Artificial Sequence: Synthetic peptide
  XENP024428 vhCDR1
HYGIN

SEQ ID NO: 2253 - protein, 17 aa, Artificial Sequence
  Description of Artificial Sequence: Synthetic peptide
  XENP024428 vhCDR2
WINTYTGEPTYADGFTG

SEQ ID NO: 2254 - protein, 8 aa, Artificial Sequence
  Description of Artificial Sequence: Synthetic peptide
  XENP024428 vhCDR3
DYYGSSPY

SEQ ID NO: 2255 - protein, 16 aa, Artificial Sequence
  Description of Artificial Sequence: Synthetic peptide
  XENP024428 vlCDR1
KSSQSIVHSNGNTYLE

SEQ ID NO: 2256 - protein, 7 aa, Artificial Sequence
  Description of Artificial Sequence: Synthetic peptide
  XENP024428 vlCDR2
KVSNRFS

SEQ ID NO: 2257 - protein, 9 aa, Artificial Sequence
  Description of Artificial Sequence: Synthetic peptide
  XENP024428 vlCDR3
FQGSHVPNT

SEQ ID NO: 2258 - protein, 251 aa, Artificial Sequence
  Description of Artificial Sequence: Synthetic polypeptide
  XENP024429 1C11_H3.181_L3_scFv
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2259 - protein, 117 aa, Artificial Sequence
  Description of Artificial Sequence: Synthetic polypeptide
  VH of XENP024429
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSS

SEQ ID NO: 2260 - protein, 114 aa, Artificial Sequence; identical to SEQ ID NO: 649
  Description of Artificial Sequence: Synthetic polypeptide
  VL of XENP024429

SEQ ID NO: 2261 - protein, 5 aa, Artificial Sequence
  Description of Artificial Sequence: Synthetic peptide
  XENP024429 vhCDR1
HYGIN

SEQ ID NO: 2262 - protein, 17 aa, Artificial Sequence
  Description of Artificial Sequence: Synthetic peptide
  XENP024429 vhCDR2
WINTYTGEPTYADGFTG

SEQ ID NO: 2263 - protein, 8 aa, Artificial Sequence
  Description of Artificial Sequence: Synthetic peptide
  XENP024429 vhCDR3
DYYGSSPY

SEQ ID NO: 2264 - protein, 16 aa, Artificial Sequence
  Description of Artificial Sequence: Synthetic peptide
  XENP024429 vlCDR1
KSSQSIVHSNGNTYLE

SEQ ID NO: 2265 - protein, 7 aa, Artificial Sequence
  Description of Artificial Sequence: Synthetic peptide
  XENP024429 vlCDR2
KVSNRFS

SEQ ID NO: 2266 - protein, 9 aa, Artificial Sequence
  Description of Artificial Sequence: Synthetic peptide
  XENP024429 vlCDR3
FQGSHVPNT

SEQ ID NO: 2267 - protein, 251 aa, Artificial Sequence
  Description of Artificial Sequence: Synthetic polypeptide
  XENP024430 1C11_H3.182_L3_scFv
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2268 - protein, 117 aa, Artificial Sequence
  Description of Artificial Sequence: Synthetic polypeptide
  VH of XENP024430
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 2269 - protein, 114 aa, Artificial Sequence; identical to SEQ ID NO: 649
  Description of Artificial Sequence: Synthetic polypeptide
  VL of XENP024430

SEQ ID NO: 2270 - protein, 5 aa, Artificial Sequence
  Description of Artificial Sequence: Synthetic peptide
  XENP024430 vhCDR1
HYGMN

SEQ ID NO: 2271 - protein, 17 aa, Artificial Sequence
  Description of Artificial Sequence: Synthetic peptide
  XENP024430 vhCDR2
WINTYTGEPTYADGFTG

SEQ ID NO: 2272 - protein, 8 aa, Artificial Sequence
  Description of Artificial Sequence: Synthetic peptide
  XENP024430 vhCDR3
DYYGSSPY

SEQ ID NO: 2273 - protein, 16 aa, Artificial Sequence
  Description of Artificial Sequence: Synthetic peptide
  XENP024430 vlCDR1
KSSQSIVHSNGNTYLE

SEQ ID NO: 2274 - protein, 7 aa, Artificial Sequence
  Description of Artificial Sequence: Synthetic peptide
  XENP024430 vlCDR2
KVSNRFS

SEQ ID NO: 2275 - protein, 9 aa, Artificial Sequence
  Description of Artificial Sequence: Synthetic peptide
  XENP024430 vlCDR3
FQGSHVPNT

SEQ ID NO: 2276 - protein, 251 aa, Artificial Sequence
  Description of Artificial Sequence: Synthetic polypeptide
  XENP024431 1C11_H3.183_L3_scFv
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2277 - protein, 117 aa, Artificial Sequence
  Description of Artificial Sequence: Synthetic polypeptide
  VH of XENP024431
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 2278 - protein, 114 aa, Artificial Sequence; identical to SEQ ID NO: 649
  Description of Artificial Sequence: Synthetic polypeptide
  VL of XENP024431

SEQ ID NO: 2279 - protein, 5 aa, Artificial Sequence
  Description of Artificial Sequence: Synthetic peptide
  XENP024431 vhCDR1
HYGMN

SEQ ID NO: 2280 - protein, 17 aa, Artificial Sequence
  Description of Artificial Sequence: Synthetic peptide
  XENP024431 vhCDR2
WINTYTGEPTYADGFTG

SEQ ID NO: 2281 - protein, 8 aa, Artificial Sequence
  Description of Artificial Sequence: Synthetic peptide
  XENP024431 vhCDR3
DYYGSSPY

SEQ ID NO: 2282 - protein, 16 aa, Artificial Sequence
  Description of Artificial Sequence: Synthetic peptide
  XENP024431 vlCDR1
KSSQSIVHSNGNTYLE

SEQ ID NO: 2283 - protein, 7 aa, Artificial Sequence
  Description of Artificial Sequence: Synthetic peptide
  XENP024431 vlCDR2
KVSNRFS

SEQ ID NO: 2284 - protein, 9 aa, Artificial Sequence
  Description of Artificial Sequence: Synthetic peptide
  XENP024431 vlCDR3
FQGSHVPNT

SEQ ID NO: 2285 - protein, 251 aa, Artificial Sequence
  Description of Artificial Sequence: Synthetic polypeptide
  XENP024432 1C11_H3.184_L3_scFv
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2286 - protein, 117 aa, Artificial Sequence
  Description of Artificial Sequence: Synthetic polypeptide
  VH of XENP024432
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 2287 - protein, 114 aa, Artificial Sequence; identical to SEQ ID NO: 649
  Description of Artificial Sequence: Synthetic polypeptide
  VL of XENP024432

SEQ ID NO: 2288 - protein, 5 aa, Artificial Sequence
  Description of Artificial Sequence: Synthetic peptide
  XENP024432 vhCDR1
HYGMN

SEQ ID NO: 2289 - protein, 17 aa, Artificial Sequence
  Description of Artificial Sequence: Synthetic peptide
  XENP024432 vhCDR2
WINTYTGEPTYADGFTG

SEQ ID NO: 2290 - protein, 8 aa, Artificial Sequence
  Description of Artificial Sequence: Synthetic peptide
  XENP024432 vhCDR3
DYYGSSPY

SEQ ID NO: 2291 - protein, 16 aa, Artificial Sequence
  Description of Artificial Sequence: Synthetic peptide
  XENP024432 vlCDR1
KSSQSIVHSNGNTYLE

SEQ ID NO: 2292 - protein, 7 aa, Artificial Sequence
  Description of Artificial Sequence: Synthetic peptide
  XENP024432 vlCDR2
KVSNRFS

SEQ ID NO: 2293 - protein, 9 aa, Artificial Sequence
  Description of Artificial Sequence: Synthetic peptide
  XENP024432 vlCDR3
FQGSHVPNT

SEQ ID NO: 2294 - protein, 251 aa, Artificial Sequence
  Description of Artificial Sequence: Synthetic polypeptide
  XENP024433 1C11_H3.185_L3_scFv
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2295 - protein, 117 aa, Artificial Sequence
  Description of Artificial Sequence: Synthetic polypeptide
  VH of XENP024433
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSS

SEQ ID NO: 2296 - protein, 114 aa, Artificial Sequence; identical to SEQ ID NO: 649
  Description of Artificial Sequence: Synthetic polypeptide
  VL of XENP024433

SEQ ID NO: 2297 - protein, 5 aa, Artificial Sequence
  Description of Artificial Sequence: Synthetic peptide
  XENP024433 vhCDR1
HYGIN

SEQ ID NO: 2298 - protein, 17 aa, Artificial Sequence
  Description of Artificial Sequence: Synthetic peptide
  XENP024433 vhCDR2
WINTYTGEPYYAPKFTE

SEQ ID NO: 2299 - protein, 8 aa, Artificial Sequence
  Description of Artificial Sequence: Synthetic peptide
  XENP024433 vhCDR3
DYYGSSPY

SEQ ID NO: 2300 - protein, 16 aa, Artificial Sequence
  Description of Artificial Sequence: Synthetic peptide
  XENP024433 vlCDR1
KSSQSIVHSNGNTYLE

SEQ ID NO: 2301 - protein, 7 aa, Artificial Sequence
  Description of Artificial Sequence: Synthetic peptide
  XENP024433 vlCDR2
KVSNRFS

SEQ ID NO: 2302 - protein, 9 aa, Artificial Sequence
  Description of Artificial Sequence: Synthetic peptide
  XENP024433 vlCDR3
FQGSHVPNT

SEQ ID NO: 2303 - protein, 251 aa, Artificial Sequence
  Description of Artificial Sequence: Synthetic polypeptide
  XENP024434 1C11_H3.186_L3_scFv
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2304 - protein, 117 aa, Artificial Sequence
  Description of Artificial Sequence: Synthetic polypeptide
  VH of XENP024434
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSS

SEQ ID NO: 2305 - protein, 114 aa, Artificial Sequence; identical to SEQ ID NO: 649
  Description of Artificial Sequence: Synthetic polypeptide
  VL of XENP024434

SEQ ID NO: 2306 - protein, 5 aa, Artificial Sequence
  Description of Artificial Sequence: Synthetic peptide
  XENP024434 vhCDR1
HYGIN

SEQ ID NO: 2307 - protein, 17 aa, Artificial Sequence
  Description of Artificial Sequence: Synthetic peptide
  XENP024434 vhCDR2
WINTYTGEPYYAPGFTE

SEQ ID NO: 2308 - protein, 8 aa, Artificial Sequence
  Description of Artificial Sequence: Synthetic peptide
  XENP024434 vhCDR3
DYYGSSPY

SEQ ID NO: 2309 - protein, 16 aa, Artificial Sequence
  Description of Artificial Sequence: Synthetic peptide
  XENP024434 vlCDR1
KSSQSIVHSNGNTYLE

SEQ ID NO: 2310 - protein, 7 aa, Artificial Sequence
  Description of Artificial Sequence: Synthetic peptide
  XENP024434 vlCDR2
KVSNRFS

SEQ ID NO: 2311 - protein, 9 aa, Artificial Sequence
  Description of Artificial Sequence: Synthetic peptide
  XENP024434 vlCDR3
FQGSHVPNT

SEQ ID NO: 2312 - protein, 251 aa, Artificial Sequence
  Description of Artificial Sequence: Synthetic polypeptide
  XENP024435 1C11_H3.187_L3_scFv
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2313 - protein, 117 aa, Artificial Sequence
  Description of Artificial Sequence: Synthetic polypeptide
  VH of XENP024435
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSS

SEQ ID NO: 2314 - protein, 114 aa, Artificial Sequence; identical to SEQ ID NO: 649
  Description of Artificial Sequence: Synthetic polypeptide
  VL of XENP024435

SEQ ID NO: 2315 - protein, 5 aa, Artificial Sequence
  Description of Artificial Sequence: Synthetic peptide
  XENP024435 vhCDR1
HYGIN

SEQ ID NO: 2316 - protein, 17 aa, Artificial Sequence
  Description of Artificial Sequence: Synthetic peptide
  XENP024435 vhCDR2
WINTYTGEPYYAPGFTE

SEQ ID NO: 2317 - protein, 8 aa, Artificial Sequence
  Description of Artificial Sequence: Synthetic peptide
  XENP024435 vhCDR3
DYYGSSPY

SEQ ID NO: 2318 - protein, 16 aa, Artificial Sequence
  Description of Artificial Sequence: Synthetic peptide
  XENP024435 vlCDR1
KSSQSIVHSNGNTYLE

SEQ ID NO: 2319 - protein, 7 aa, Artificial Sequence
  Description of Artificial Sequence: Synthetic peptide
  XENP024435 vlCDR2
KVSNRFS

SEQ ID NO: 2320 - protein, 9 aa, Artificial Sequence
  Description of Artificial Sequence: Synthetic peptide
  XENP024435 vlCDR3
FQGSHVPNT

SEQ ID NO: 2321 - protein, 251 aa, Artificial Sequence
  Description of Artificial Sequence: Synthetic polypeptide
  XENP024436 1C11_H3.188_L3_scFv
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2322 - protein, 117 aa, Artificial Sequence
  Description of Artificial Sequence: Synthetic polypeptide
  VH of XENP024436
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 2323 - protein, 114 aa, Artificial Sequence; identical to SEQ ID NO: 649
  Description of Artificial Sequence: Synthetic polypeptide
  VL of XENP024436

SEQ ID NO: 2324 - protein, 5 aa, Artificial Sequence
  Description of Artificial Sequence: Synthetic peptide
  XENP024436 vhCDR1
HYGIN

SEQ ID NO: 2325 - protein, 17 aa, Artificial Sequence
  Description of Artificial Sequence: Synthetic peptide
  XENP024436 vhCDR2
WINTYTGEPYYAPGFTG

SEQ ID NO: 2326 - protein, 8 aa, Artificial Sequence
  Description of Artificial Sequence: Synthetic peptide
  XENP024436 vhCDR3
DYYGSSPY

SEQ ID NO: 2327 - protein, 16 aa, Artificial Sequence
  Description of Artificial Sequence: Synthetic peptide
  XENP024436 vlCDR1
KSSQSIVHSNGNTYLE

SEQ ID NO: 2328 - protein, 7 aa, Artificial Sequence
  Description of Artificial Sequence: Synthetic peptide
  XENP024436 vlCDR2
KVSNRFS

SEQ ID NO: 2329 - protein, 9 aa, Artificial Sequence
  Description of Artificial Sequence: Synthetic peptide
  XENP024436 vlCDR3
FQGSHVPNT

SEQ ID NO: 2330 - protein, 251 aa, Artificial Sequence
  Description of Artificial Sequence: Synthetic polypeptide
  XENP024437 1C11_H3.189_L3_scFv
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2331 - protein, 117 aa, Artificial Sequence
  Description of Artificial Sequence: Synthetic polypeptide
  VH of XENP024437
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSS

SEQ ID NO: 2332 - protein, 114 aa, Artificial Sequence; identical to SEQ ID NO: 649
  Description of Artificial Sequence: Synthetic polypeptide
  VL of XENP024437

SEQ ID NO: 2333 - protein, 5 aa, Artificial Sequence
  Description of Artificial Sequence: Synthetic peptide
  XENP024437 vhCDR1
HYGIN

SEQ ID NO: 2334 - protein, 17 aa, Artificial Sequence
  Description of Artificial Sequence: Synthetic peptide
  XENP024437 vhCDR2
WINTYTGEPYYAPKFTG

SEQ ID NO: 2335 - protein, 8 aa, Artificial Sequence
  Description of Artificial Sequence: Synthetic peptide
  XENP024437 vhCDR3
DYYGSSPY

SEQ ID NO: 2336 - protein, 16 aa, Artificial Sequence
  Description of Artificial Sequence: Synthetic peptide
  XENP024437 vlCDR1
KSSQSIVHSNGNTYLE

SEQ ID NO: 2337 - protein, 7 aa, Artificial Sequence
  Description of Artificial Sequence: Synthetic peptide
  XENP024437 vlCDR2
KVSNRFS

SEQ ID NO: 2338 - protein, 9 aa, Artificial Sequence
  Description of Artificial Sequence: Synthetic peptide
  XENP024437 vlCDR3
FQGSHVPNT

SEQ ID NO: 2339 - protein, 251 aa, Artificial Sequence
  Description of Artificial Sequence: Synthetic polypeptide
  XENP024438 1C11_H3.190_L3_scFv
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2340 - protein, 117 aa, Artificial Sequence
  Description of Artificial Sequence: Synthetic polypeptide
  VH of XENP024438
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 2341 - protein, 114 aa, Artificial Sequence; identical to SEQ ID NO: 649
  Description of Artificial Sequence: Synthetic polypeptide
  VL of XENP024438

SEQ ID NO: 2342 - protein, 5 aa, Artificial Sequence
  Description of Artificial Sequence: Synthetic peptide
  XENP024438 vhCDR1
HYGIN

SEQ ID NO: 2343 - protein, 17 aa, Artificial Sequence
  Description of Artificial Sequence: Synthetic peptide
  XENP024438 vhCDR2
WINTYTGEPYYAPGFTG

SEQ ID NO: 2344 - protein, 8 aa, Artificial Sequence
  Description of Artificial Sequence: Synthetic peptide
  XENP024438 vhCDR3
DYYGSSPY

SEQ ID NO: 2345 - protein, 16 aa, Artificial Sequence
  Description of Artificial Sequence: Synthetic peptide
  XENP024438 vlCDR1
KSSQSIVHSNGNTYLE

SEQ ID NO: 2346 - protein, 7 aa, Artificial Sequence
  Description of Artificial Sequence: Synthetic peptide
  XENP024438 vlCDR2
KVSNRFS

SEQ ID NO: 2347 - protein, 9 aa, Artificial Sequence
  Description of Artificial Sequence: Synthetic peptide
  XENP024438 vlCDR3
FQGSHVPNT

SEQ ID NO: 2348 - protein, 251 aa, Artificial Sequence
  Description of Artificial Sequence: Synthetic polypeptide
  XENP024439 1C11_H3.191_L3_scFv
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2349 - protein, 117 aa, Artificial Sequence
  Description of Artificial Sequence: Synthetic polypeptide
  VH of XENP024439
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSS

SEQ ID NO: 2350 - protein, 114 aa, Artificial Sequence; identical to SEQ ID NO: 649
  Description of Artificial Sequence: Synthetic polypeptide
  VL of XENP024439

SEQ ID NO: 2351 - protein, 5 aa, Artificial Sequence
  Description of Artificial Sequence: Synthetic peptide
  XENP024439 vhCDR1
HYGMN

SEQ ID NO: 2352 - protein, 17 aa, Artificial Sequence
  Description of Artificial Sequence: Synthetic peptide
  XENP024439 vhCDR2
WINTYTGEPTYAPGFTG

SEQ ID NO: 2353 - protein, 8 aa, Artificial Sequence
  Description of Artificial Sequence: Synthetic peptide
  XENP024439 vhCDR3
DYYGSSPY

SEQ ID NO: 2354 - protein, 16 aa, Artificial Sequence
  Description of Artificial Sequence: Synthetic peptide
  XENP024439 vlCDR1
KSSQSIVHSNGNTYLE

SEQ ID NO: 2355 - protein, 7 aa, Artificial Sequence
  Description of Artificial Sequence: Synthetic peptide
  XENP024439 vlCDR2
KVSNRFS

SEQ ID NO: 2356 - protein, 9 aa, Artificial Sequence
  Description of Artificial Sequence: Synthetic peptide
  XENP024439 vlCDR3
FQGSHVPNT

SEQ ID NO: 2357 - protein, 251 aa, Artificial Sequence
  Description of Artificial Sequence: Synthetic polypeptide
  XENP024440 1C11_H3.192_L3_scFv
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2358 - protein, 117 aa, Artificial Sequence
  Description of Artificial Sequence: Synthetic polypeptide
  VH of XENP024440
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSS

SEQ ID NO: 2359 - protein, 114 aa, Artificial Sequence; identical to SEQ ID NO: 649
  Description of Artificial Sequence: Synthetic polypeptide
  VL of XENP024440

SEQ ID NO: 2360 - protein, 5 aa, Artificial Sequence
  Description of Artificial Sequence: Synthetic peptide
  XENP024440 vhCDR1
HYGIN

SEQ ID NO: 2361 - protein, 17 aa, Artificial Sequence
  Description of Artificial Sequence: Synthetic peptide
  XENP024440 vhCDR2
WINTYTGEPTYADGFTE

SEQ ID NO: 2362 - protein, 8 aa, Artificial Sequence
  Description of Artificial Sequence: Synthetic peptide
  XENP024440 vhCDR3
DYYGSSPY

SEQ ID NO: 2363 - protein, 16 aa, Artificial Sequence
  Description of Artificial Sequence: Synthetic peptide
  XENP024440 vlCDR1
KSSQSIVHSNGNTYLE

SEQ ID NO: 2364 - protein, 7 aa, Artificial Sequence
  Description of Artificial Sequence: Synthetic peptide
  XENP024440 vlCDR2
KVSNRFS

SEQ ID NO: 2365 - protein, 9 aa, Artificial Sequence
  Description of Artificial Sequence: Synthetic peptide
  XENP024440 vlCDR3
FQGSHVPNT

SEQ ID NO: 2366 - protein, 251 aa, Artificial Sequence
  Description of Artificial Sequence: Synthetic polypeptide
  XENP024441 1C11_H3.193_L3_scFv
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2367 - protein, 117 aa, Artificial Sequence
  Description of Artificial Sequence: Synthetic polypeptide
  VH of XENP024441
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSS

SEQ ID NO: 2368 - protein, 114 aa, Artificial Sequence; identical to SEQ ID NO: 649
  Description of Artificial Sequence: Synthetic polypeptide
  VL of XENP024441

SEQ ID NO: 2369 - protein, 5 aa, Artificial Sequence
  Description of Artificial Sequence: Synthetic peptide
  XENP024441 vhCDR1
HYGMN

SEQ ID NO: 2370 - protein, 17 aa, Artificial Sequence
  Description of Artificial Sequence: Synthetic peptide
  XENP024441 vhCDR2
WINTYTGEPTYAPGFTE

SEQ ID NO: 2371 - protein, 8 aa, Artificial Sequence
  Description of Artificial Sequence: Synthetic peptide
  XENP024441 vhCDR3
DYYGSSPY

SEQ ID NO: 2372 - protein, 16 aa, Artificial Sequence
  Description of Artificial Sequence: Synthetic peptide
  XENP024441 vlCDR1
KSSQSIVHSNGNTYLE

SEQ ID NO: 2373 - protein, 7 aa, Artificial Sequence
  Description of Artificial Sequence: Synthetic peptide
  XENP024441 vlCDR2
KVSNRFS

SEQ ID NO: 2374 - protein, 9 aa, Artificial Sequence
  Description of Artificial Sequence: Synthetic peptide
  XENP024441 vlCDR3
FQGSHVPNT

SEQ ID NO: 2375 - protein, 251 aa, Artificial Sequence
  Description of Artificial Sequence: Synthetic polypeptide
  XENP024442 1C11_H3.194_L3_scFv
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2376 - protein, 117 aa, Artificial Sequence
  Description of Artificial Sequence: Synthetic polypeptide
  VH of XENP024442
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSS

SEQ ID NO: 2377 - protein, 114 aa, Artificial Sequence; identical to SEQ ID NO: 649
  Description of Artificial Sequence: Synthetic polypeptide
  VL of XENP024442

SEQ ID NO: 2378 - protein, 5 aa, Artificial Sequence
  Description of Artificial Sequence: Synthetic peptide
  XENP024442 vhCDR1
HYGIN

SEQ ID NO: 2379 - protein, 17 aa, Artificial Sequence
  Description of Artificial Sequence: Synthetic peptide
  XENP024442 vhCDR2
WINTYTGEPTYADGFTG

SEQ ID NO: 2380 - protein, 8 aa, Artificial Sequence
  Description of Artificial Sequence: Synthetic peptide
  XENP024442 vhCDR3
DYYGSSPY

SEQ ID NO: 2381 - protein, 16 aa, Artificial Sequence
  Description of Artificial Sequence: Synthetic peptide
  XENP024442 vlCDR1
KSSQSIVHSNGNTYLE

SEQ ID NO: 2382 - protein, 7 aa, Artificial Sequence
  Description of Artificial Sequence: Synthetic peptide
  XENP024442 vlCDR2
KVSNRFS

SEQ ID NO: 2383 - protein, 9 aa, Artificial Sequence
  Description of Artificial Sequence: Synthetic peptide
  XENP024442 vlCDR3
FQGSHVPNT

SEQ ID NO: 2384 - protein, 251 aa, Artificial Sequence
  Description of Artificial Sequence: Synthetic polypeptide
  XENP024443 1C11_H3.195_L3_scFv
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 2385 - protein, 117 aa, Artificial Sequence
  Description of Artificial Sequence: Synthetic polypeptide
  VH of XENP024443
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSS

SEQ ID NO: 2386 - protein, 114 aa, Artificial Sequence; identical to SEQ ID NO: 649
  Description of Artificial Sequence: Synthetic polypeptide
  VL of XENP024443

SEQ ID NO: 2387 - protein, 5 aa, Artificial Sequence
  Description of Artificial Sequence: Synthetic peptide
  XENP024443 vhCDR1
HYGMN

SEQ ID NO: 2388 - protein, 17 aa, Artificial Sequence
  Description of Artificial Sequence: Synthetic peptide
  XENP024443 vhCDR2
WINTYTGEPYYADGFTG

SEQ ID NO: 2389 - protein, 8 aa, Artificial Sequence
  Description of Artificial Sequence: Synthetic peptide
  XENP024443 vhCDR3
DYYGSSPY

SEQ ID NO: 2390 - protein, 16 aa, Artificial Sequence
  Description of Artificial Sequence: Synthetic peptide
  XENP024443 vlCDR1
KSSQSIVHSNGNTYLE

SEQ ID NO: 2391 - protein, 7 aa, Artificial Sequence
  Description of Artificial Sequence: Synthetic peptide
  XENP024443 vlCDR2
KVSNRFS

SEQ ID NO: 2392 - protein, 9 aa, Artificial Sequence
  Description of Artificial Sequence: Synthetic peptide
  XENP024443 vlCDR3
FQGSHVPNT

SEQ ID NO: 2393 - protein, 231 aa, Artificial Sequence
  Description of Artificial Sequence: Synthetic polypeptide
  XENP022835 empty-[CTLA-4]_H3.23_L0.129_scFv Empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2394 - protein, 477 aa, Artificial Sequence
  Description of Artificial Sequence: Synthetic polypeptide
  XENP022835 empty-[CTLA-4]_H3.23_L0.129_scFv scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2395 - protein, 118 aa, Artificial Sequence
  Description of Artificial Sequence: Synthetic polypeptide
  VH of XENP022835
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS

SEQ ID NO: 2396 - protein, 108 aa, Artificial Sequence
  Description of Artificial Sequence: Synthetic polypeptide
  VL of XENP022835
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2397 - protein, 231 aa, Artificial Sequence
  Description of Artificial Sequence: Synthetic polypeptide
  Fc chain of XENP022835
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2398 - protein, 5 aa, Artificial Sequence
  Description of Artificial Sequence: Synthetic peptide
  XENP022835 vhCDR1
SYTMH

SEQ ID NO: 2399 - protein, 17 aa, Artificial Sequence
  Description of Artificial Sequence: Synthetic peptide
  XENP022835 vhCDR2
FISYDGNYKYYADSVKG

SEQ ID NO: 2400 - protein, 9 aa, Artificial Sequence
  Description of Artificial Sequence: Synthetic peptide
  XENP022835 vhCDR3
GGHLGPFDL

SEQ ID NO: 2401 - protein, 12 aa, Artificial Sequence
  Description of Artificial Sequence: Synthetic peptide
  XENP022835 vlCDR1
RASQSVGSSYLA

SEQ ID NO: 2402 - protein, 7 aa, Artificial Sequence
  Description of Artificial Sequence: Synthetic peptide
  XENP022835 vlCDR2
GASSRAT

SEQ ID NO: 2403 - protein, 9 aa, Artificial Sequence
  Description of Artificial Sequence: Synthetic peptide
  XENP022835 vlCDR3
QQYGSSPWT

SEQ ID NO: 2404 - protein, 447 aa, Artificial Sequence
  Description of Artificial Sequence: Synthetic polypeptide
  XENP023552 [CTLA-4]_H3_L0.22_Fab-empty_Fc(216)_IgG1 Fab-Fc Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2405 - protein, 118 aa, Artificial Sequence
  Description of Artificial Sequence: Synthetic polypeptide
  VH of XENP023552
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS

SEQ ID NO: 2406 - protein, 5 aa, Artificial Sequence
  Description of Artificial Sequence: Synthetic peptide
  XENP023552 vhCDR1
SYTMH

SEQ ID NO: 2407 - protein, 17 aa, Artificial Sequence
  Description of Artificial Sequence: Synthetic peptide
  XENP023552 vhCDR2
FISYDGNNKYYADSVKG

SEQ ID NO: 2408 - protein, 9 aa, Artificial Sequence
  Description of Artificial Sequence: Synthetic peptide
  XENP023552 vhCDR3
TGWLGPFDY

SEQ ID NO: 2409 - protein, 231 aa, Artificial Sequence
  Description of Artificial Sequence: Synthetic polypeptide
  XENP023552 [CTLA-4]_H3_L0.22_Fab-empty_Fc(216)_IgG1 Empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2410 - protein, 215 aa, Artificial Sequence
  Description of Artificial Sequence: Synthetic polypeptide
  XENP023552 [CTLA-4]_H3_L0.22_Fab-empty_Fc(216)_IgG1 Light Chain
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2411 - protein, 108 aa, Artificial Sequence
  Description of Artificial Sequence: Synthetic polypeptide
  VL of XENP023552
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2412 - protein, 12 aa, Artificial Sequence
  Description of Artificial Sequence: Synthetic peptide
  XENP023552 vlCDR1
RASQSVSSSYLA

SEQ ID NO: 2413 - protein, 7 aa, Artificial Sequence
  Description of Artificial Sequence: Synthetic peptide
  XENP023552 vlCDR2
GAFSRAT

SEQ ID NO: 2414 - protein, 9 aa, Artificial Sequence
  Description of Artificial Sequence: Synthetic peptide
  XENP023552 vlCDR3
QQYGSSPWT

SEQ ID NO: 2415 - protein, 226 aa, Artificial Sequence
  Description of Artificial Sequence: Synthetic polypeptide
  XENP023041 7G8_H3.66_L1.34_Fab Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2416 - protein, 121 aa, Artificial Sequence
  Description of Artificial Sequence: Synthetic polypeptide
  VH of XENP023041
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2417 - protein, 5 aa, Artificial Sequence
  Description of Artificial Sequence: Synthetic peptide
  XENP023041 vhCDR1
EAWMS

SEQ ID NO: 2418 - protein, 19 aa, Artificial Sequence
  Description of Artificial Sequence: Synthetic peptide
  XENP023041 vhCDR2
EISTKANNHATYYAESVKG

SEQ ID NO: 2419 - protein, 10 aa, Artificial Sequence
  Description of Artificial Sequence: Synthetic peptide
  XENP023041 vhCDR3
LATWDWYFDV

SEQ ID NO: 2420 - protein, 218 aa, Artificial Sequence
  Description of Artificial Sequence: Synthetic polypeptide
  XENP023041 7G8_H3.66_L1.34_Fab Light Chain
DIVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2421 - protein, 111 aa, Artificial Sequence
  Description of Artificial Sequence: Synthetic polypeptide
  VL of XENP023041
DIVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIK

SEQ ID NO: 2422 - protein, 15 aa, Artificial Sequence
  Description of Artificial Sequence: Synthetic peptide
  XENP023041 vlCDR1
RASQSVDYDGDSYMN

SEQ ID NO: 2423 - protein, 7 aa, Artificial Sequence
  Description of Artificial Sequence: Synthetic peptide
  XENP023041 vlCDR2
AASELES

SEQ ID NO: 2424 - protein, 9 aa, Artificial Sequence
  Description of Artificial Sequence: Synthetic peptide
  XENP023041 vlCDR3
QQSNEDPFT

SEQ ID NO: 2425 - protein, 226 aa, Artificial Sequence
  Description of Artificial Sequence: Synthetic polypeptide
  XENP023042 7G8_H3.67_L1.34_Fab Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2426 - protein, 121 aa, Artificial Sequence
  Description of Artificial Sequence: Synthetic polypeptide
  VH of XENP023042
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2427 - protein, 5 aa, Artificial Sequence
  Description of Artificial Sequence: Synthetic peptide
  XENP023042 vhCDR1
DTWMS

SEQ ID NO: 2428 - protein, 19 aa, Artificial Sequence
  Description of Artificial Sequence: Synthetic peptide
  XENP023042 vhCDR2
EISTKANNHATYYAESVKG

SEQ ID NO: 2429 - protein, 10 aa, Artificial Sequence
  Description of Artificial Sequence: Synthetic peptide
  XENP023042 vhCDR3
LATWDWYFDV

SEQ ID NO: 2430 - protein, 218 aa, Artificial Sequence; identical to SEQ ID NO: 2420
  Description of Artificial Sequence: Synthetic polypeptide
  XENP023042 7G8_H3.67_L1.34_Fab Light Chain

SEQ ID NO: 2431 - protein, 111 aa, Artificial Sequence; identical to SEQ ID NO: 2421
  Description of Artificial Sequence: Synthetic polypeptide
  VL of XENP023042

SEQ ID NO: 2432 - protein, 15 aa, Artificial Sequence
  Description of Artificial Sequence: Synthetic peptide
  XENP023042 vlCDR1
RASQSVDYDGDSYMN

SEQ ID NO: 2433 - protein, 7 aa, Artificial Sequence
  Description of Artificial Sequence: Synthetic peptide
  XENP023042 vlCDR2
AASELES

SEQ ID NO: 2434 - protein, 9 aa, Artificial Sequence
  Description of Artificial Sequence: Synthetic peptide
  XENP023042 vlCDR3
QQSNEDPFT

SEQ ID NO: 2435 - protein, 226 aa, Artificial Sequence
  Description of Artificial Sequence: Synthetic polypeptide
  XENP023043 7G8_H3.68_L1.34_Fab Heavy Chain
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2436 - protein, 121 aa, Artificial Sequence
  Description of Artificial Sequence: Synthetic polypeptide
  VH of XENP023043
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2437 - protein, 5 aa, Artificial Sequence
  Description of Artificial Sequence: Synthetic peptide
  XENP023043 vhCDR1
DKWMS

SEQ ID NO: 2438 - protein, 19 aa, Artificial Sequence
  Description of Artificial Sequence: Synthetic peptide
  XENP023043 vhCDR2
EISTKANNHATYYAESVKG

SEQ ID NO: 2439 - protein, 10 aa, Artificial Sequence
  Description of Artificial Sequence: Synthetic peptide
  XENP023043 vhCDR3
LATWDWYFDV

SEQ ID NO: 2440 - protein, 218 aa, Artificial Sequence; identical to SEQ ID NO: 2420
  Description of Artificial Sequence: Synthetic polypeptide
  XENP023043 7G8_H3.68_L1.34_Fab Light Chain

SEQ ID NO: 2441 - protein, 111 aa, Artificial Sequence; identical to SEQ ID NO: 2421
  Description of Artificial Sequence: Synthetic polypeptide
  VL of XENP023043

SEQ ID NO: 2442 - protein, 15 aa, Artificial Sequence
  Description of Artificial Sequence: Synthetic peptide
  XENP023043 vlCDR1
RASQSVDYDGDSYMN

SEQ ID NO: 2443 - protein, 7 aa, Artificial Sequence
  Description of Artificial Sequence: Synthetic peptide
  XENP023043 vlCDR2
AASELES

SEQ ID NO: 2444 - protein, 9 aa, Artificial Sequence
  Description of Artificial Sequence: Synthetic peptide
  XENP023043 vlCDR3
QQSNEDPFT

SEQ ID NO: 2445 - protein, 226 aa, Artificial Sequence
  Description of Artificial Sequence: Synthetic polypeptide
  XENP023044 7G8_H3.69_L1.34_Fab Heavy Chain
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2446 - protein, 121 aa, Artificial Sequence
  Description of Artificial Sequence: Synthetic polypeptide
  VH of XENP023044
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2447 - protein, 5 aa, Artificial Sequence
  Description of Artificial Sequence: Synthetic peptide
  XENP023044 vhCDR1
DAFMS

SEQ ID NO: 2448 - protein, 19 aa, Artificial Sequence
  Description of Artificial Sequence: Synthetic peptide
  XENP023044 vhCDR2
EISTKANNHATYYAESVKG

SEQ ID NO: 2449 - protein, 10 aa, Artificial Sequence
  Description of Artificial Sequence: Synthetic peptide
  XENP023044 vhCDR3
LATWDWYFDV

SEQ ID NO: 2450 - protein, 218 aa, Artificial Sequence; identical to SEQ ID NO: 2420
  Description of Artificial Sequence: Synthetic polypeptide
  XENP023044 7G8_H3.69_L1.34_Fab Light Chain

SEQ ID NO: 2451 - protein, 111 aa, Artificial Sequence; identical to SEQ ID NO: 2421
  Description of Artificial Sequence: Synthetic polypeptide
  VL of XENP023044

SEQ ID NO: 2452 - protein, 15 aa, Artificial Sequence
  Description of Artificial Sequence: Synthetic peptide
  XENP023044 vlCDR1
RASQSVDYDGDSYMN

SEQ ID NO: 2453 - protein, 7 aa, Artificial Sequence
  Description of Artificial Sequence: Synthetic peptide
  XENP023044 vlCDR2
AASELES

SEQ ID NO: 2454 - protein, 9 aa, Artificial Sequence
  Description of Artificial Sequence: Synthetic peptide
  XENP023044 vlCDR3
QQSNEDPFT

SEQ ID NO: 2455 - protein, 226 aa, Artificial Sequence
  Description of Artificial Sequence: Synthetic polypeptide
  XENP023045 7G8_H3.70_L1.34_Fab Heavy Chain
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2456 - protein, 121 aa, Artificial Sequence
  Description of Artificial Sequence: Synthetic polypeptide
  VH of XENP023045
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2457 - protein, 5 aa, Artificial Sequence
  Description of Artificial Sequence: Synthetic peptide
  XENP023045 vhCDR1
DAYMS

SEQ ID NO: 2458 - protein, 19 aa, Artificial Sequence
  Description of Artificial Sequence: Synthetic peptide
  XENP023045 vhCDR2
EISTKANNHATYYAESVKG

SEQ ID NO: 2459 - protein, 10 aa, Artificial Sequence
  Description of Artificial Sequence: Synthetic peptide
  XENP023045 vhCDR3
LATWDWYFDV

SEQ ID NO: 2460 - protein, 218 aa, Artificial Sequence; identical to SEQ ID NO: 2420
  Description of Artificial Sequence: Synthetic polypeptide
  XENP023045 7G8_H3.70_L1.34_Fab Light Chain

SEQ ID NO: 2461 - protein, 111 aa, Artificial Sequence; identical to SEQ ID NO: 2421
  Description of Artificial Sequence: Synthetic polypeptide
  VL of XENP023045

SEQ ID NO: 2462 - protein, 15 aa, Artificial Sequence
  Description of Artificial Sequence: Synthetic peptide
  XENP023045 vlCDR1
RASQSVDYDGDSYMN

SEQ ID NO: 2463 - protein, 7 aa, Artificial Sequence
  Description of Artificial Sequence: Synthetic peptide
  XENP023045 vlCDR2
AASELES

SEQ ID NO: 2464 - protein, 9 aa, Artificial Sequence
  Description of Artificial Sequence: Synthetic peptide
  XENP023045 vlCDR3
QQSNEDPFT

SEQ ID NO: 2465 - protein, 226 aa, Artificial Sequence
  Description of Artificial Sequence: Synthetic polypeptide
  XENP023046 7G8_H3.71_L1.34_Fab Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2466 - protein, 121 aa, Artificial Sequence
  Description of Artificial Sequence: Synthetic polypeptide
  VH of XENP023046
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 2467 - protein, 5 aa, Artificial Sequence
  Description of Artificial Sequence: Synthetic peptide
  XENP023046 vhCDR1
DAWMS

SEQ ID NO: 2468 - protein, 19 aa, Artificial Sequence
  Description of Artificial Sequence: Synthetic peptide
  XENP023046 vhCDR2
EISTKAYNHATYYAESVKG

SEQ ID NO: 2469 - protein, 10 aa, Artificial Sequence
  Description of Artificial Sequence: Synthetic peptide
  XENP023046 vhCDR3
LATWDWYFDV

SEQ ID NO: 2470 - protein, 218 aa, Artificial Sequence; identical to SEQ ID NO: 2420
  Description of Artificial Sequence: Synthetic polypeptide
  XENP023046 7G8_H3.71_L1.34_Fab Light Chain

SEQ ID NO: 2471 - protein, 111 aa, Artificial Sequence; identical to SEQ ID NO: 2421
  Description of Artificial Sequence: Synthetic polypeptide
  VL of XENP023046

SEQ ID NO: 2472 - protein, 15 aa, Artificial Sequence
  Description of Artificial Sequence: Synthetic peptide
  XENP023046 vlCDR1
RASQSVDYDGDSYMN

SEQ ID NO: 2473 - protein, 7 aa, Artificial Sequence
  Description of Artificial Sequence: Synthetic peptide
  XENP023046 vlCDR2
AASELES

SEQ ID NO: 2474 - protein, 9 aa, Artificial Sequence
  Description of Artificial Sequence: Synthetic peptide
  XENP023046 vlCDR3
QQSNEDPFT

SEQ ID NO: 2475 - protein, 226 aa, Artificial Sequence
  Description of Artificial Sequence: Synthetic polypeptide
  XENP023047 7G8_H3.72_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2476 - protein, 121 aa, Artificial Sequence
  Description of Artificial Sequence: Synthetic polypeptide
  VH of XENP023047
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSS

SEQ ID NO: 2477 - protein, 5 aa, Artificial Sequence
  Description of Artificial Sequence: Synthetic peptide
  XENP023047 vhCDR1
DAWMS

SEQ ID NO: 2478 - protein, 19 aa, Artificial Sequence
  Description of Artificial Sequence: Synthetic peptide
  XENP023047 vhCDR2
EISTKANNHATYYAESVKG

SEQ ID NO: 2479 - protein, 10 aa, Artificial Sequence
  Description of Artificial Sequence: Synthetic peptide
  XENP023047 vhCDR3
LATFDWYFDV

SEQ ID NO: 2480 - protein, 218 aa, Artificial Sequence; identical to SEQ ID NO: 2420
  Description of Artificial Sequence: Synthetic polypeptide
  XENP023047 7G8_H3.72_L1.34_Fab Light Chain

SEQ ID NO: 2481 - protein, 111 aa, Artificial Sequence; identical to SEQ ID NO: 2421
  Description of Artificial Sequence: Synthetic polypeptide
  VL of XENP023047

SEQ ID NO: 2482 - protein, 15 aa, Artificial Sequence
  Description of Artificial Sequence: Synthetic peptide
  XENP023047 vlCDR1
RASQSVDYDGDSYMN

SEQ ID NO: 2483 - protein, 7 aa, Artificial Sequence
  Description of Artificial Sequence: Synthetic peptide
  XENP023047 vlCDR2
AASELES

SEQ ID NO: 2484 - protein, 9 aa, Artificial Sequence
  Description of Artificial Sequence: Synthetic peptide
  XENP023047 vlCDR3
QQSNEDPFT

SEQ ID NO: 2485 - protein, 226 aa, Artificial Sequence
  Description of Artificial Sequence: Synthetic polypeptide
  XENP023048 7G8_H3.73_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2486 - protein, 121 aa, Artificial Sequence
  Description of Artificial Sequence: Synthetic polypeptide
  VH of XENP023048
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSS

SEQ ID NO: 2487 - protein, 5 aa, Artificial Sequence
  Description of Artificial Sequence: Synthetic peptide
  XENP023048 vhCDR1
DAWMS

SEQ ID NO: 2488 - protein, 19 aa, Artificial Sequence
  Description of Artificial Sequence: Synthetic peptide
  XENP023048 vhCDR2
EISTKANNHATYYAESVKG

SEQ ID NO: 2489 - protein, 10 aa, Artificial Sequence
  Description of Artificial Sequence: Synthetic peptide
  XENP023048 vhCDR3
LATYDWYFDV

SEQ ID NO: 2490 - protein, 218 aa, Artificial Sequence; identical to SEQ ID NO: 2420
  Description of Artificial Sequence: Synthetic polypeptide
  XENP023048 7G8_H3.73_L1.34_Fab Light Chain

SEQ ID NO: 2491 - protein, 111 aa, Artificial Sequence; identical to SEQ ID NO: 2421
  Description of Artificial Sequence: Synthetic polypeptide
  VL of XENP023048

SEQ ID NO: 2492 - protein, 15 aa, Artificial Sequence
  Description of Artificial Sequence: Synthetic peptide
  XENP023048 vlCDR1
RASQSVDYDGDSYMN

SEQ ID NO: 2493 - protein, 7 aa, Artificial Sequence
  Description of Artificial Sequence: Synthetic peptide
  XENP023048 vlCDR2
AASELES

SEQ ID NO: 2494 - protein, 9 aa, Artificial Sequence
  Description of Artificial Sequence: Synthetic peptide
  XENP023048 vlCDR3
QQSNEDPFT

SEQ ID NO: 2495 - protein, 226 aa, Artificial Sequence
  Description of Artificial Sequence: Synthetic polypeptide
  XENP023049 7G8_H3.74_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2496 - protein, 121 aa, Artificial Sequence
  Description of Artificial Sequence: Synthetic polypeptide
  VH of XENP023049
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSS

SEQ ID NO: 2497 - protein, 5 aa, Artificial Sequence
  Description of Artificial Sequence: Synthetic peptide
  XENP023049 vhCDR1
DAWMS

SEQ ID NO: 2498 - protein, 19 aa, Artificial Sequence
  Description of Artificial Sequence: Synthetic peptide
  XENP023049 vhCDR2
EISTKANNHATYYAESVKG

SEQ ID NO: 2499 - protein, 10 aa, Artificial Sequence
  Description of Artificial Sequence: Synthetic peptide
  XENP023049 vhCDR3
LATWDFYFDV

SEQ ID NO: 2500 - protein, 218 aa, Artificial Sequence; identical to SEQ ID NO: 2420
  Description of Artificial Sequence: Synthetic polypeptide
  XENP023049 7G8_H3.74_L1.34_Fab Light Chain

SEQ ID NO: 2501 - protein, 111 aa, Artificial Sequence; identical to SEQ ID NO: 2421
  Description of Artificial Sequence: Synthetic polypeptide
  VL of XENP023049

SEQ ID NO: 2502 - protein, 15 aa, Artificial Sequence
  Description of Artificial Sequence: Synthetic peptide
  XENP023049 vlCDR1
RASQSVDYDGDSYMN

SEQ ID NO: 2503 - protein, 7 aa, Artificial Sequence
  Description of Artificial Sequence: Synthetic peptide
  XENP023049 vlCDR2
AASELES

SEQ ID NO: 2504 - protein, 9 aa, Artificial Sequence
  Description of Artificial Sequence: Synthetic peptide
  XENP023049 vlCDR3
QQSNEDPFT

SEQ ID NO: 2505 - protein, 226 aa, Artificial Sequence
  Description of Artificial Sequence: Synthetic polypeptide
  XENP023050 7G8_H3.75_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2506 - protein, 121 aa, Artificial Sequence
  Description of Artificial Sequence: Synthetic polypeptide
  VH of XENP023050
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSS

SEQ ID NO: 2507 - protein, 5 aa, Artificial Sequence
  Description of Artificial Sequence: Synthetic peptide
  XENP023050 vhCDR1
DAWMS

SEQ ID NO: 2508 - protein, 19 aa, Artificial Sequence
  Description of Artificial Sequence: Synthetic peptide
  XENP023050 vhCDR2
EISTKANNHATYYAESVKG

SEQ ID NO: 2509 - protein, 10 aa, Artificial Sequence
  Description of Artificial Sequence: Synthetic peptide
  XENP023050 vhCDR3
LATWDYYFDV

SEQ ID NO: 2510 - protein, 218 aa, Artificial Sequence; identical to SEQ ID NO: 2420
  Description of Artificial Sequence: Synthetic polypeptide
  XENP023050 7G8_H3.75_L1.34_Fab Light Chain

SEQ ID NO: 2511 - protein, 111 aa, Artificial Sequence; identical to SEQ ID NO: 2421
  Description of Artificial Sequence: Synthetic polypeptide
  VL of XENP023050

SEQ ID NO: 2512 - protein, 15 aa, Artificial Sequence
  Description of Artificial Sequence: Synthetic peptide
  XENP023050 vlCDR1
RASQSVDYDGDSYMN

SEQ ID NO: 2513 - protein, 7 aa, Artificial Sequence
  Description of Artificial Sequence: Synthetic peptide
  XENP023050 vlCDR2
AASELES

SEQ ID NO: 2514 - protein, 9 aa, Artificial Sequence
  Description of Artificial Sequence: Synthetic peptide
  XENP023050 vlCDR3
QQSNEDPFT

SEQ ID NO: 2515 - protein, 226 aa, Artificial Sequence
  Description of Artificial Sequence: Synthetic polypeptide
  XENP023051 7G8_H3.30_L1.38_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 2516 - protein, 121 aa, Artificial Sequence
  Description of Artificial Sequence: Synthetic polypeptide
  VH of XENP023051
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 2517 - protein, 5 aa, Artificial Sequence
  Description of Artificial Sequence: Synthetic peptide
  XENP023051 vhCDR1
DAWMS

SEQ ID NO: 2518 - protein, 19 aa, Artificial Sequence
  Description of Artificial Sequence: Synthetic peptide
  XENP023051 vhCDR2
EISTKANNHATYYAESVKG

SEQ ID NO: 2519 - protein, 10 aa, Artificial Sequence
  Description of Artificial Sequence: Synthetic peptide
  XENP023051 vhCDR3
LATWDWYFDV

SEQ ID NO: 2520 - protein, 218 aa, Artificial Sequence
  Description of Artificial Sequence: Synthetic polypeptide
  XENP023051 7G8_H3.30_L1.38_Fab Light Chain
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2521 - protein, 111 aa, Artificial Sequence
  Description of Artificial Sequence: Synthetic polypeptide
  VL of XENP023051
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIK

SEQ ID NO: 2522 - protein, 15 aa, Artificial Sequence
  Description of Artificial Sequence: Synthetic peptide
  XENP023051 vlCDR1
RASQSVDYEGDSYMN

SEQ ID NO: 2523 - protein, 7 aa, Artificial Sequence
  Description of Artificial Sequence: Synthetic peptide
  XENP023051 vlCDR2
AASELES

SEQ ID NO: 2524 - protein, 9 aa, Artificial Sequence
  Description of Artificial Sequence: Synthetic peptide
  XENP023051 vlCDR3
QQSNEDPFT

SEQ ID NO: 2525 - protein, 226 aa, Artificial Sequence; identical to SEQ ID NO: 2515
  Description of Artificial Sequence: Synthetic polypeptide
  XENP023052 7G8_H3.30_L1.39_Fab Heavy Chain

SEQ ID NO: 2526 - protein, 121 aa, Artificial Sequence; identical to SEQ ID NO: 2516
  Description of Artificial Sequence: Synthetic polypeptide
  VH of XENP023052

SEQ ID NO: 2527 - protein, 5 aa, Artificial Sequence
  Description of Artificial Sequence: Synthetic peptide
  XENP023052 vhCDR1
DAWMS

SEQ ID NO: 2528 - protein, 19 aa, Artificial Sequence
  Description of Artificial Sequence: Synthetic peptide
  XENP023052 vhCDR2
EISTKANNHATYYAESVKG

SEQ ID NO: 2529 - protein, 10 aa, Artificial Sequence
  Description of Artificial Sequence: Synthetic peptide
  XENP023052 vhCDR3
LATWDWYFDV

SEQ ID NO: 2530 - protein, 218 aa, Artificial Sequence
  Description of Artificial Sequence: Synthetic polypeptide
  XENP023052 7G8_H3.30_L1.39_Fab Light Chain
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2531 - protein, 111 aa, Artificial Sequence
  Description of Artificial Sequence: Synthetic polypeptide
  VL of XENP023052
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIK

SEQ ID NO: 2532 - protein, 15 aa, Artificial Sequence
  Description of Artificial Sequence: Synthetic peptide
  XENP023052 vlCDR1
RASQSVDYYGDSYMN

SEQ ID NO: 2533 - protein, 7 aa, Artificial Sequence
  Description of Artificial Sequence: Synthetic peptide
  XENP023052 vlCDR2
AASELES

SEQ ID NO: 2534 - protein, 9 aa, Artificial Sequence
  Description of Artificial Sequence: Synthetic peptide
  XENP023052 vlCDR3
QQSNEDPFT

SEQ ID NO: 2535 - protein, 226 aa, Artificial Sequence; identical to SEQ ID NO: 2515
  Description of Artificial Sequence: Synthetic polypeptide
  XENP023053 7G8_H3.30_L1.40_Fab Heavy Chain

SEQ ID NO: 2536 - protein, 121 aa, Artificial Sequence; identical to SEQ ID NO: 2516
  Description of Artificial Sequence: Synthetic polypeptide
  VH of XENP023053

SEQ ID NO: 2537 - protein, 5 aa, Artificial Sequence
  Description of Artificial Sequence: Synthetic peptide
  XENP023053 vhCDR1
DAWMS

SEQ ID NO: 2538 - protein, 19 aa, Artificial Sequence
  Description of Artificial Sequence: Synthetic peptide
  XENP023053 vhCDR2
EISTKANNHATYYAESVKG

SEQ ID NO: 2539 - protein, 10 aa, Artificial Sequence
  Description of Artificial Sequence: Synthetic peptide
  XENP023053 vhCDR3
LATWDWYFDV

SEQ ID NO: 2540 - protein, 218 aa, Artificial Sequence
  Description of Artificial Sequence: Synthetic polypeptide
  XENP023053 7G8_H3.30_L1.40_Fab Light Chain
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2541 - protein, 111 aa, Artificial Sequence
  Description of Artificial Sequence: Synthetic polypeptide
  VL of XENP023053
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIK

SEQ ID NO: 2542 - protein, 15 aa, Artificial Sequence
  Description of Artificial Sequence: Synthetic peptide
  XENP023053 vlCDR1
RASQSVDYDADSYMN

SEQ ID NO: 2543 - protein, 7 aa, Artificial Sequence
  Description of Artificial Sequence: Synthetic peptide
  XENP023053 vlCDR2
AASELES

SEQ ID NO: 2544 - protein, 9 aa, Artificial Sequence
  Description of Artificial Sequence: Synthetic peptide
  XENP023053 vlCDR3
QQSNEDPFT

SEQ ID NO: 2545 - protein, 226 aa, Artificial Sequence; identical to SEQ ID NO: 2515
  Description of Artificial Sequence: Synthetic polypeptide
  XENP023054 7G8_H3.30_L1.41_Fab Heavy Chain

SEQ ID NO: 2546 - protein, 121 aa, Artificial Sequence; identical to SEQ ID NO: 2516
  Description of Artificial Sequence: Synthetic polypeptide
  VH of XENP023054

SEQ ID NO: 2547 - protein, 5 aa, Artificial Sequence
  Description of Artificial Sequence: Synthetic peptide
  XENP023054 vhCDR1
DAWMS

SEQ ID NO: 2548 - protein, 19 aa, Artificial Sequence
  Description of Artificial Sequence: Synthetic peptide
  XENP023054 vhCDR2
EISTKANNHATYYAESVKG

SEQ ID NO: 2549 - protein, 10 aa, Artificial Sequence
  Description of Artificial Sequence: Synthetic peptide
  XENP023054 vhCDR3
LATWDWYFDV

SEQ ID NO: 2550 - protein, 218 aa, Artificial Sequence
  Description of Artificial Sequence: Synthetic polypeptide
  XENP023054 7G8_H3.30_L1.41_Fab Light Chain
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2551 - protein, 111 aa, Artificial Sequence
  Description of Artificial Sequence: Synthetic polypeptide
  VL of XENP023054
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIK

SEQ ID NO: 2552 - protein, 15 aa, Artificial Sequence
  Description of Artificial Sequence: Synthetic peptide
  XENP023054 vlCDR1
RASQSVDYDQDSYMN

SEQ ID NO: 2553 - protein, 7 aa, Artificial Sequence
  Description of Artificial Sequence: Synthetic peptide
  XENP023054 vlCDR2
AASELES

SEQ ID NO: 2554 - protein, 9 aa, Artificial Sequence
  Description of Artificial Sequence: Synthetic peptide
  XENP023054 vlCDR3
QQSNEDPFT

SEQ ID NO: 2555 - protein, 226 aa, Artificial Sequence; identical to SEQ ID NO: 2515
  Description of Artificial Sequence: Synthetic polypeptide
  XENP023055 7G8_H3.30_L1.42_Fab Heavy Chain

SEQ ID NO: 2556 - protein, 121 aa, Artificial Sequence; identical to SEQ ID NO: 2516
  Description of Artificial Sequence: Synthetic polypeptide
  VH of XENP023055

SEQ ID NO: 2557 - protein, 5 aa, Artificial Sequence
  Description of Artificial Sequence: Synthetic peptide
  XENP023055 vhCDR1
DAWMS

SEQ ID NO: 2558 - protein, 19 aa, Artificial Sequence
  Description of Artificial Sequence: Synthetic peptide
  XENP023055 vhCDR2
EISTKANNHATYYAESVKG

SEQ ID NO: 2559 - protein, 10 aa, Artificial Sequence
  Description of Artificial Sequence: Synthetic peptide
  XENP023055 vhCDR3
LATWDWYFDV

SEQ ID NO: 2560 - protein, 218 aa, Artificial Sequence
  Description of Artificial Sequence: Synthetic polypeptide
  XENP023055 7G8_H3.30_L1.42_Fab Light Chain
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2561 - protein, 111 aa, Artificial Sequence
  Description of Artificial Sequence: Synthetic polypeptide
  VL of XENP023055
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIK

SEQ ID NO: 2562 - protein, 15 aa, Artificial Sequence
  Description of Artificial Sequence: Synthetic peptide
  XENP023055 vlCDR1
RASQSVDYDDDSYMN

SEQ ID NO: 2563 - protein, 7 aa, Artificial Sequence
  Description of Artificial Sequence: Synthetic peptide
  XENP023055 vlCDR2
AASELES

SEQ ID NO: 2564 - protein, 9 aa, Artificial Sequence
  Description of Artificial Sequence: Synthetic peptide
  XENP023055 vlCDR3
QQSNEDPFT

SEQ ID NO: 2565 - protein, 226 aa, Artificial Sequence; identical to SEQ ID NO: 2515
  Description of Artificial Sequence: Synthetic polypeptide
  XENP023056 7G8_H3.30_L1.43_Fab Heavy Chain

SEQ ID NO: 2566 - protein, 121 aa, Artificial Sequence; identical to SEQ ID NO: 2516
  Description of Artificial Sequence: Synthetic polypeptide
  VH of XENP023056

SEQ ID NO: 2567 - protein, 5 aa, Artificial Sequence
  Description of Artificial Sequence: Synthetic peptide
  XENP023056 vhCDR1
DAWMS

SEQ ID NO: 2568 - protein, 19 aa, Artificial Sequence
  Description of Artificial Sequence: Synthetic peptide
  XENP023056 vhCDR2
EISTKANNHATYYAESVKG

SEQ ID NO: 2569 - protein, 10 aa, Artificial Sequence
  Description of Artificial Sequence: Synthetic peptide
  XENP023056 vhCDR3
LATWDWYFDV

SEQ ID NO: 2570 - protein, 218 aa, Artificial Sequence
  Description of Artificial Sequence: Synthetic polypeptide
  XENP023056 7G8_H3.30_L1.43_Fab Light Chain
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2571 - protein, 111 aa, Artificial Sequence
  Description of Artificial Sequence: Synthetic polypeptide
  VL of XENP023056
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIK

SEQ ID NO: 2572 - protein, 15 aa, Artificial Sequence
  Description of Artificial Sequence: Synthetic peptide
  XENP023056 vlCDR1
RASQSVDYDYDSYMN

SEQ ID NO: 2573 - protein, 7 aa, Artificial Sequence
  Description of Artificial Sequence: Synthetic peptide
  XENP023056 vlCDR2
AASELES

SEQ ID NO: 2574 - protein, 9 aa, Artificial Sequence
  Description of Artificial Sequence: Synthetic peptide
  XENP023056 vlCDR3
QQSNEDPFT

SEQ ID NO: 2575 - protein, 226 aa, Artificial Sequence; identical to SEQ ID NO: 2415
  Description of Artificial Sequence: Synthetic polypeptide
  XENP023220 7G8_H3.66_L1.39_Fab Heavy Chain

SEQ ID NO: 2576 - protein, 121 aa, Artificial Sequence; identical to SEQ ID NO: 2416
  Description of Artificial Sequence: Synthetic polypeptide
  VH of XENP023220

SEQ ID NO: 2577 - protein, 5 aa, Artificial Sequence
  Description of Artificial Sequence: Synthetic peptide
  XENP023220 vhCDR1
EAWMS

SEQ ID NO: 2578 - protein, 19 aa, Artificial Sequence
  Description of Artificial Sequence: Synthetic peptide
  XENP023220 vhCDR2
EISTKANNHATYYAESVKG

SEQ ID NO: 2579 - protein, 10 aa, Artificial Sequence
  Description of Artificial Sequence: Synthetic peptide
  XENP023220 vhCDR3
LATWDWYFDV

SEQ ID NO: 2580 - protein, 218 aa, Artificial Sequence; identical to SEQ ID NO: 2530
  Description of Artificial Sequence: Synthetic polypeptide
  XENP023220 7G8_H3.66_L1.39_Fab Light Chain

SEQ ID NO: 2581 - protein, 111 aa, Artificial Sequence; identical to SEQ ID NO: 2531
  Description of Artificial Sequence: Synthetic polypeptide
  VL of XENP023220

SEQ ID NO: 2582 - protein, 15 aa, Artificial Sequence
  Description of Artificial Sequence: Synthetic peptide
  XENP023220 vlCDR1
RASQSVDYYGDSYMN

SEQ ID NO: 2583 - protein, 7 aa, Artificial Sequence
  Description of Artificial Sequence: Synthetic peptide
  XENP023220 vlCDR2
AASELES

SEQ ID NO: 2584 - protein, 9 aa, Artificial Sequence
  Description of Artificial Sequence: Synthetic peptide
  XENP023220 vlCDR3
QQSNEDPFT

SEQ ID NO: 2585 - protein, 226 aa, Artificial Sequence; identical to SEQ ID NO: 2425
  Description of Artificial Sequence: Synthetic polypeptide
  XENP023221 7G8_H3.67_L1.39_Fab Heavy Chain

SEQ ID NO: 2586 - protein, 121 aa, Artificial Sequence; identical to SEQ ID NO: 2426
  Description of Artificial Sequence: Synthetic polypeptide
  VH of XENP023221

SEQ ID NO: 2587 - protein, 5 aa, Artificial Sequence
  Description of Artificial Sequence: Synthetic peptide
  XENP023221 vhCDR1
DTWMS

SEQ ID NO: 2588 - protein, 19 aa, Artificial Sequence
  Description of Artificial Sequence: Synthetic peptide
  XENP023221 vhCDR2
EISTKANNHATYYAESVKG

SEQ ID NO: 2589 - protein, 10 aa, Artificial Sequence
  Description of Artificial Sequence: Synthetic peptide
  XENP023221 vhCDR3
LATWDWYFDV

SEQ ID NO: 2590 - protein, 218 aa, Artificial Sequence; identical to SEQ ID NO: 2530
  Description of Artificial Sequence: Synthetic polypeptide
  XENP023221 7G8_H3.67_L1.39_Fab Light Chain

SEQ ID NO: 2591 - protein, 111 aa, Artificial Sequence; identical to SEQ ID NO: 2531
  Description of Artificial Sequence: Synthetic polypeptide
  VL of XENP023221

SEQ ID NO: 2592 - protein, 15 aa, Artificial Sequence
  Description of Artificial Sequence: Synthetic peptide
  XENP023221 vlCDR1
RASQSVDYYGDSYMN

SEQ ID NO: 2593 - protein, 7 aa, Artificial Sequence
  Description of Artificial Sequence: Synthetic peptide
  XENP023221 vlCDR2
AASELES

SEQ ID NO: 2594 - protein, 9 aa, Artificial Sequence
  Description of Artificial Sequence: Synthetic peptide
  XENP023221 vlCDR3
QQSNEDPFT

SEQ ID NO: 2595 - protein, 226 aa, Artificial Sequence; identical to SEQ ID NO: 2465
  Description of Artificial Sequence: Synthetic polypeptide
  XENP023222 7G8_H3.71_L1.39_Fab Heavy Chain

SEQ ID NO: 2596 - protein, 121 aa, Artificial Sequence; identical to SEQ ID NO: 2466
  Description of Artificial Sequence: Synthetic polypeptide
  VH of XENP023222

SEQ ID NO: 2597 - protein, 5 aa, Artificial Sequence
  Description of Artificial Sequence: Synthetic peptide
  XENP023222 vhCDR1
DAWMS

SEQ ID NO: 2598 - protein, 19 aa, Artificial Sequence
  Description of Artificial Sequence: Synthetic peptide
  XENP023222 vhCDR2
EISTKAYNHATYYAESVKG

SEQ ID NO: 2599 - protein, 10 aa, Artificial Sequence
  Description of Artificial Sequence: Synthetic peptide
  XENP023222 vhCDR3
LATWDWYFDV

SEQ ID NO: 2600 - protein, 218 aa, Artificial Sequence; identical to SEQ ID NO: 2530
  Description of Artificial Sequence: Synthetic polypeptide
  XENP023222 7G8_H3.71_L1.39_Fab Light Chain

SEQ ID NO: 2601 - protein, 111 aa, Artificial Sequence; identical to SEQ ID NO: 2531
  Description of Artificial Sequence: Synthetic polypeptide
  VL of XENP023222

SEQ ID NO: 2602 - protein, 15 aa, Artificial Sequence
  Description of Artificial Sequence: Synthetic peptide
  XENP023222 vlCDR1
RASQSVDYYGDSYMN

SEQ ID NO: 2603 - protein, 7 aa, Artificial Sequence
  Description of Artificial Sequence: Synthetic peptide
  XENP023222 vlCDR2
AASELES

SEQ ID NO: 2604 - protein, 9 aa, Artificial Sequence
  Description of Artificial Sequence: Synthetic peptide
  XENP023222 vlCDR3
QQSNEDPFT

SEQ ID NO: 2605 - protein, 450 aa, Artificial Sequence
  Description of Artificial Sequence: Synthetic polypeptide
  XENP022841 7G8_H3.30_L1.34_Fab-[CTLA-4]_H3.23_L0.129_scFv Fab -Fc Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2606 - protein, 121 aa, Artificial Sequence; identical to SEQ ID NO: 2516
  Description of Artificial Sequence: Synthetic polypeptide
  VH of XENP022841

SEQ ID NO: 2607 - protein, 5 aa, Artificial Sequence
  Description of Artificial Sequence: Synthetic peptide
  XENP022841 vhCDR1
DAWMS

SEQ ID NO: 2608 - protein, 19 aa, Artificial Sequence
  Description of Artificial Sequence: Synthetic peptide
  XENP022841 vhCDR2
EISTKANNHATYYAESVKG

SEQ ID NO: 2609 - protein, 10 aa, Artificial Sequence
  Description of Artificial Sequence: Synthetic peptide
  XENP022841 vhCDR3
LATWDWYFDV

SEQ ID NO: 2610 - protein, 477 aa, Artificial Sequence
  Description of Artificial Sequence: Synthetic polypeptide
  XENP022841 7G8_H3.30_L1.34_Fab-[CTLA-4]_H3.23_L0.129_scFv scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2611 - protein, 118 aa, Artificial Sequence; identical to SEQ ID NO: 2395
  Description of Artificial Sequence: Synthetic polypeptide
  VH of XENP022841

SEQ ID NO: 2612 - protein, 108 aa, Artificial Sequence; identical to SEQ ID NO: 2396
  Description of Artificial Sequence: Synthetic polypeptide
  VL of XENP022841

SEQ ID NO: 2613 - protein, 231 aa, Artificial Sequence; identical to SEQ ID NO: 2409
  Description of Artificial Sequence: Synthetic polypeptide
  Fc chain of XENP022841

SEQ ID NO: 2614 - protein, 5 aa, Artificial Sequence
  Description of Artificial Sequence: Synthetic peptide
  XENP022841 vhCDR1
SYTMH

SEQ ID NO: 2615 - protein, 17 aa, Artificial Sequence
  Description of Artificial Sequence: Synthetic peptide
  XENP022841 vhCDR2
FISYDGNYKYYADSVKG

SEQ ID NO: 2616 - protein, 9 aa, Artificial Sequence
  Description of Artificial Sequence: Synthetic peptide
  XENP022841 vhCDR3
GGHLGPFDL

SEQ ID NO: 2617 - protein, 12 aa, Artificial Sequence
  Description of Artificial Sequence: Synthetic peptide
  XENP022841 vlCDR1
RASQSVGSSYLA

SEQ ID NO: 2618 - protein, 7 aa, Artificial Sequence
  Description of Artificial Sequence: Synthetic peptide
  XENP022841 vlCDR2
GASSRAT

SEQ ID NO: 2619 - protein, 9 aa, Artificial Sequence
  Description of Artificial Sequence: Synthetic peptide
  XENP022841 vlCDR3
QQYGSSPWT

SEQ ID NO: 2620 - protein, 218 aa, Artificial Sequence; identical to SEQ ID NO: 2420
  Description of Artificial Sequence: Synthetic polypeptide
  XENP022841 7G8_H3.30_L1.34_Fab-[CTLA-4]_H3.23_L0.129_scFv Light Chain

SEQ ID NO: 2621 - protein, 111 aa, Artificial Sequence; identical to SEQ ID NO: 2421
  Description of Artificial Sequence: Synthetic polypeptide
  VL of XENP022841

SEQ ID NO: 2622 - protein, 15 aa, Artificial Sequence
  Description of Artificial Sequence: Synthetic peptide
  XENP022841 vlCDR1
RASQSVDYDGDSYMN

SEQ ID NO: 2623 - protein, 7 aa, Artificial Sequence
  Description of Artificial Sequence: Synthetic peptide
  XENP022841 vlCDR2
AASELES

SEQ ID NO: 2624 - protein, 9 aa, Artificial Sequence
  Description of Artificial Sequence: Synthetic peptide
  XENP022841 vlCDR3
QQSNEDPFT

SEQ ID NO: 2625 - protein, 450 aa, Artificial Sequence; identical to SEQ ID NO: 2605
  Description of Artificial Sequence: Synthetic polypeptide
  XENP022842 7G8_H3.30_L1.36_Fab-[CTLA-4]_H3.23_L0.129_scFv Fab-Fc Heavy Chain

SEQ ID NO: 2626 - protein, 121 aa, Artificial Sequence; identical to SEQ ID NO: 2516
  Description of Artificial Sequence: Synthetic polypeptide
  VH of XENP022842

SEQ ID NO: 2627 - protein, 5 aa, Artificial Sequence
  Description of Artificial Sequence: Synthetic peptide
  XENP022842 vhCDR1
DAWMS

SEQ ID NO: 2628 - protein, 19 aa, Artificial Sequence
  Description of Artificial Sequence: Synthetic peptide
  XENP022842 vhCDR2
EISTKANNHATYYAESVKG

SEQ ID NO: 2629 - protein, 10 aa, Artificial Sequence
  Description of Artificial Sequence: Synthetic peptide
  XENP022842 vhCDR3
LATWDWYFDV

SEQ ID NO: 2630 - protein, 477 aa, Artificial Sequence; identical to SEQ ID NO: 2610
  Description of Artificial Sequence: Synthetic polypeptide
  XENP022842 7G8_H3.30_L1.36_Fab-[CTLA-4]_H3.23_L0.129_scFv sc Fv-Fc Heavy Chain

SEQ ID NO: 2631 - protein, 118 aa, Artificial Sequence; identical to SEQ ID NO: 2395
  Description of Artificial Sequence: Synthetic polypeptide
  VH of XENP022842

SEQ ID NO: 2632 - protein, 108 aa, Artificial Sequence; identical to SEQ ID NO: 2396
  Description of Artificial Sequence: Synthetic polypeptide
  VL of XENP022842

SEQ ID NO: 2633 - protein, 231 aa, Artificial Sequence; identical to SEQ ID NO: 2409
  Description of Artificial Sequence: Synthetic polypeptide
  Fc chain of XENP022842

SEQ ID NO: 2634 - protein, 5 aa, Artificial Sequence
  Description of Artificial Sequence: Synthetic peptide
  XENP022842 vhCDR1
SYTMH

SEQ ID NO: 2635 - protein, 17 aa, Artificial Sequence
  Description of Artificial Sequence: Synthetic peptide
  XENP022842 vhCDR2
FISYDGNYKYYADSVKG

SEQ ID NO: 2636 - protein, 9 aa, Artificial Sequence
  Description of Artificial Sequence: Synthetic peptide
  XENP022842 vhCDR3
GGHLGPFDL

SEQ ID NO: 2637 - protein, 12 aa, Artificial Sequence
  Description of Artificial Sequence: Synthetic peptide
  XENP022842 vlCDR1
RASQSVGSSYLA

SEQ ID NO: 2638 - protein, 7 aa, Artificial Sequence
  Description of Artificial Sequence: Synthetic peptide
  XENP022842 vlCDR2
GASSRAT

SEQ ID NO: 2639 - protein, 9 aa, Artificial Sequence
  Description of Artificial Sequence: Synthetic peptide
  XENP022842 vlCDR3
QQYGSSPWT

SEQ ID NO: 2640 - protein, 218 aa, Artificial Sequence
  Description of Artificial Sequence: Synthetic polypeptide
  XENP022842 7G8_H3.30_L1.36_Fab-[CTLA-4]_H3.23_L0.129_scFv Light Chain
DIVLTQSPSSLSASVGDRVTITCRASQSVDHDGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2641 - protein, 111 aa, Artificial Sequence
  Description of Artificial Sequence: Synthetic polypeptide
  VL of XENP022842
DIVLTQSPSSLSASVGDRVTITCRASQSVDHDGDSYMNWYQQKPGKPPKLLIYAASELESGIPARFSGSGSGTDFTLTISSLQPEDFATYYCQQSNEDPFTFGSGTKLEIK

SEQ ID NO: 2642 - protein, 15 aa, Artificial Sequence
  Description of Artificial Sequence: Synthetic peptide
  XENP022842 vlCDR1
RASQSVDHDGDSYMN

SEQ ID NO: 2643 - protein, 7 aa, Artificial Sequence
  Description of Artificial Sequence: Synthetic peptide
  XENP022842 vlCDR2
AASELES

SEQ ID NO: 2644 - protein, 9 aa, Artificial Sequence
  Description of Artificial Sequence: Synthetic peptide
  XENP022842 vlCDR3
QQSNEDPFT

SEQ ID NO: 2645 - protein, 447 aa, Artificial Sequence
  Description of Artificial Sequence: Synthetic polypeptide
  XENP022843 2A11_H1.144_L2.142_Fab-[CTLA-4]_H3.23_L0.129_scFv Fab-Fc Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2646 - protein, 118 aa, Artificial Sequence
  Description of Artificial Sequence: Synthetic polypeptide
  VH of XENP022843
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSS

SEQ ID NO: 2647 - protein, 5 aa, Artificial Sequence
  Description of Artificial Sequence: Synthetic peptide
  XENP022843 vhCDR1
DYFMH

SEQ ID NO: 2648 - protein, 17 aa, Artificial Sequence
  Description of Artificial Sequence: Synthetic peptide
  XENP022843 vhCDR2
WIDPELGDTEYAPKFQG

SEQ ID NO: 2649 - protein, 9 aa, Artificial Sequence
  Description of Artificial Sequence: Synthetic peptide
  XENP022843 vhCDR3
RGVYQALDY

SEQ ID NO: 2650 - protein, 477 aa, Artificial Sequence; identical to SEQ ID NO: 2610
  Description of Artificial Sequence: Synthetic polypeptide
  XENP022843 2A11_H1.144_L2.142_Fab-[CTLA-4]_H3.23_L0.129_scFv scFv-Fc Heavy Chain

SEQ ID NO: 2651 - protein, 118 aa, Artificial Sequence; identical to SEQ ID NO: 2395
  Description of Artificial Sequence: Synthetic polypeptide
  VH of XENP022843

SEQ ID NO: 2652 - protein, 108 aa, Artificial Sequence; identical to SEQ ID NO: 2396
  Description of Artificial Sequence: Synthetic polypeptide
  VL of XENP022843

SEQ ID NO: 2653 - protein, 231 aa, Artificial Sequence; identical to SEQ ID NO: 2409
  Description of Artificial Sequence: Synthetic polypeptide
  Fc chain of XENP022843

SEQ ID NO: 2654 - protein, 5 aa, Artificial Sequence
  Description of Artificial Sequence: Synthetic peptide
  XENP022843 vhCDR1
SYTMH

SEQ ID NO: 2655 - protein, 17 aa, Artificial Sequence
  Description of Artificial Sequence: Synthetic peptide
  XENP022843 vhCDR2
FISYDGNYKYYADSVKG

SEQ ID NO: 2656 - protein, 9 aa, Artificial Sequence
  Description of Artificial Sequence: Synthetic peptide
  XENP022843 vhCDR3
GGHLGPFDL

SEQ ID NO: 2657 - protein, 12 aa, Artificial Sequence
  Description of Artificial Sequence: Synthetic peptide
  XENP022843 vlCDR1
RASQSVGSSYLA

SEQ ID NO: 2658 - protein, 7 aa, Artificial Sequence
  Description of Artificial Sequence: Synthetic peptide
  XENP022843 vlCDR2
GASSRAT

SEQ ID NO: 2659 - protein, 9 aa, Artificial Sequence
  Description of Artificial Sequence: Synthetic peptide
  XENP022843 vlCDR3
QQYGSSPWT

SEQ ID NO: 2660 - protein, 214 aa, Artificial Sequence
  Description of Artificial Sequence: Synthetic polypeptide
  XENP022843 2A11_H1.144_L2.142_Fab-[CTLA-4]_H3.23_L0.129_scFv Light Chain
DIQMTQSPAFLSVTPGEKVTITCQASQDIGNYLNWFQQKPGQTVKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2661 - protein, 107 aa, Artificial Sequence
  Description of Artificial Sequence: Synthetic polypeptide
  VL of XENP022843
DIQMTQSPAFLSVTPGEKVTITCQASQDIGNYLNWFQQKPGQTVKLLIYFTSYLHSGVPSRFSGSGSGTDYTFTISSLEAEDAATYFCQQGNTLPYTFGGGTKVEIK

SEQ ID NO: 2662 - protein, 11 aa, Artificial Sequence
  Description of Artificial Sequence: Synthetic peptide
  XENP022843 vlCDR1
QASQDIGNYLN

SEQ ID NO: 2663 - protein, 7 aa, Artificial Sequence
  Description of Artificial Sequence: Synthetic peptide
  XENP022843 vlCDR2
FTSYLHS

SEQ ID NO: 2664 - protein, 9 aa, Artificial Sequence
  Description of Artificial Sequence: Synthetic peptide
  XENP022843 vlCDR3
QQGNTLPYT

SEQ ID NO: 2665 - protein, 447 aa, Artificial Sequence; identical to SEQ ID NO: 2645
  Description of Artificial Sequence: Synthetic polypeptide
  XENP022844 2A11_H1.144_L2.113_Fab-[CTLA-4]_H3.23_L0.129_scFv Fab-Fc Heavy Chain

SEQ ID NO: 2666 - protein, 118 aa, Artificial Sequence; identical to SEQ ID NO: 2646
  Description of Artificial Sequence: Synthetic polypeptide
  VH of XENP022844

SEQ ID NO: 2667 - protein, 5 aa, Artificial Sequence
  Description of Artificial Sequence: Synthetic peptide
  XENP022844 vhCDR1
DYFMH

SEQ ID NO: 2668 - protein, 17 aa, Artificial Sequence
  Description of Artificial Sequence: Synthetic peptide
  XENP022844 vhCDR2
WIDPELGDTEYAPKFQG

SEQ ID NO: 2669 - protein, 9 aa, Artificial Sequence
  Description of Artificial Sequence: Synthetic peptide
  XENP022844 vhCDR3
RGVYQALDY

SEQ ID NO: 2670 - protein, 477 aa, Artificial Sequence; identical to SEQ ID NO: 2610
  Description of Artificial Sequence: Synthetic polypeptide
  XENP022844 2A11_H1.144_L2.113_Fab-[CTLA-4]_H3.23_L0.129_scFv scFv-Fc Heavy Chain

SEQ ID NO: 2671 - protein, 118 aa, Artificial Sequence; identical to SEQ ID NO: 2395
  Description of Artificial Sequence: Synthetic polypeptide
  VH of XENP022844

SEQ ID NO: 2672 - protein, 108 aa, Artificial Sequence; identical to SEQ ID NO: 2396
  Description of Artificial Sequence: Synthetic polypeptide
  VL of XENP022844

SEQ ID NO: 2673 - protein, 231 aa, Artificial Sequence; identical to SEQ ID NO: 2409
  Description of Artificial Sequence: Synthetic polypeptide
  Fc chain of XENP022844

SEQ ID NO: 2674 - protein, 5 aa, Artificial Sequence
  Description of Artificial Sequence: Synthetic peptide
  XENP022844 vhCDR1
SYTMH

SEQ ID NO: 2675 - protein, 17 aa, Artificial Sequence
  Description of Artificial Sequence: Synthetic peptide
  XENP022844 vhCDR2
FISYDGNYKYYADSVKG

SEQ ID NO: 2676 - protein, 9 aa, Artificial Sequence
  Description of Artificial Sequence: Synthetic peptide
  XENP022844 vhCDR3
GGHLGPFDL

SEQ ID NO: 2677 - protein, 12 aa, Artificial Sequence
  Description of Artificial Sequence: Synthetic peptide
  XENP022844 vlCDR1
RASQSVGSSYLA

SEQ ID NO: 2678 - protein, 7 aa, Artificial Sequence
  Description of Artificial Sequence: Synthetic peptide
  XENP022844 vlCDR2
GASSRAT

SEQ ID NO: 2679 - protein, 9 aa, Artificial Sequence
  Description of Artificial Sequence: Synthetic peptide
  XENP022844 vlCDR3
QQYGSSPWT

SEQ ID NO: 2680 - protein, 214 aa, Artificial Sequence
  Description of Artificial Sequence: Synthetic polypeptide
  XENP022844 2A11_H1.144_L2.113_Fab-[CTLA-4]_H3.23_L0.129_scFv Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2681 - protein, 107 aa, Artificial Sequence
  Description of Artificial Sequence: Synthetic polypeptide
  VL of XENP022844
DIQMTQSPAFLSVTPGEKVTITCQASQDIGNYLNWFQQKPDQTVKLLIYFTSYLHSGVPSRFSGSGSGTDYTFTISSLEAEDAATYFCQQGNTLPYTFGGGTKVEIK

SEQ ID NO: 2682 - protein, 11 aa, Artificial Sequence
  Description of Artificial Sequence: Synthetic peptide
  XENP022844 vlCDR1
QASQDIGNYLN

SEQ ID NO: 2683 - protein, 7 aa, Artificial Sequence
  Description of Artificial Sequence: Synthetic peptide
  XENP022844 vlCDR2
FTSYLHS

SEQ ID NO: 2684 - protein, 9 aa, Artificial Sequence
  Description of Artificial Sequence: Synthetic peptide
  XENP022844 vlCDR3
QQGNTLPYT

SEQ ID NO: 2685 - protein, 447 aa, Artificial Sequence
  Description of Artificial Sequence: Synthetic polypeptide
  XENP022845 2A11_H1_L2.113_Fab-[CTLA-4]_H3.23_L0.129_scFv Fab -Fc Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2686 - protein, 118 aa, Artificial Sequence
  Description of Artificial Sequence: Synthetic polypeptide
  VH of XENP022845
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 2687 - protein, 5 aa, Artificial Sequence
  Description of Artificial Sequence: Synthetic peptide
  XENP022845 vhCDR1
DYYMH

SEQ ID NO: 2688 - protein, 17 aa, Artificial Sequence
  Description of Artificial Sequence: Synthetic peptide
  XENP022845 vhCDR2
WIDPENGDTEYAPKFQG

SEQ ID NO: 2689 - protein, 9 aa, Artificial Sequence
  Description of Artificial Sequence: Synthetic peptide
  XENP022845 vhCDR3
RGVRQALDY

SEQ ID NO: 2690 - protein, 477 aa, Artificial Sequence; identical to SEQ ID NO: 2610
  Description of Artificial Sequence: Synthetic polypeptide
  XENP022845 2A11_H1_L2.113_Fab-[CTLA-4]_H3.23_L0.129_scFv scFv -Fc Heavy Chain

SEQ ID NO: 2691 - protein, 118 aa, Artificial Sequence; identical to SEQ ID NO: 2395
  Description of Artificial Sequence: Synthetic polypeptide
  VH of XENP022845

SEQ ID NO: 2692 - protein, 108 aa, Artificial Sequence; identical to SEQ ID NO: 2396
  Description of Artificial Sequence: Synthetic polypeptide
  VL of XENP022845

SEQ ID NO: 2693 - protein, 231 aa, Artificial Sequence; identical to SEQ ID NO: 2409
  Description of Artificial Sequence: Synthetic polypeptide
  Fc chain of XENP022845

SEQ ID NO: 2694 - protein, 5 aa, Artificial Sequence
  Description of Artificial Sequence: Synthetic peptide
  XENP022845 vhCDR1
SYTMH

SEQ ID NO: 2695 - protein, 17 aa, Artificial Sequence
  Description of Artificial Sequence: Synthetic peptide
  XENP022845 vhCDR2
FISYDGNYKYYADSVKG

SEQ ID NO: 2696 - protein, 9 aa, Artificial Sequence
  Description of Artificial Sequence: Synthetic peptide
  XENP022845 vhCDR3
GGHLGPFDL

SEQ ID NO: 2697 - protein, 12 aa, Artificial Sequence
  Description of Artificial Sequence: Synthetic peptide
  XENP022845 vlCDR1
RASQSVGSSYLA

SEQ ID NO: 2698 - protein, 7 aa, Artificial Sequence
  Description of Artificial Sequence: Synthetic peptide
  XENP022845 vlCDR2
GASSRAT

SEQ ID NO: 2699 - protein, 9 aa, Artificial Sequence
  Description of Artificial Sequence: Synthetic peptide
  XENP022845 vlCDR3
QQYGSSPWT

SEQ ID NO: 2700 - protein, 214 aa, Artificial Sequence; identical to SEQ ID NO: 2680
  Description of Artificial Sequence: Synthetic polypeptide
  XENP022845 2A11_H1_L2.113_Fab-[CTLA-4]_H3.23_L0.129_scFv Light Chain

SEQ ID NO: 2701 - protein, 107 aa, Artificial Sequence; identical to SEQ ID NO: 2681
  Description of Artificial Sequence: Synthetic polypeptide
  VL of XENP022845

SEQ ID NO: 2702 - protein, 11 aa, Artificial Sequence
  Description of Artificial Sequence: Synthetic peptide
  XENP022845 vlCDR1
QASQDIGNYLN

SEQ ID NO: 2703 - protein, 7 aa, Artificial Sequence
  Description of Artificial Sequence: Synthetic peptide
  XENP022845 vlCDR2
FTSYLHS

SEQ ID NO: 2704 - protein, 9 aa, Artificial Sequence
  Description of Artificial Sequence: Synthetic peptide
  XENP022845 vlCDR3
QQGNTLPYT

SEQ ID NO: 2705 - protein, 447 aa, Artificial Sequence
  Description of Artificial Sequence: Synthetic polypeptide
  XENP022846 2A11_H1.125_L2.126_Fab-[CTLA-4]_H3.23_L0.129_scFv Fab-Fc Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2706 - protein, 118 aa, Artificial Sequence
  Description of Artificial Sequence: Synthetic polypeptide
  VH of XENP022846
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSS

SEQ ID NO: 2707 - protein, 5 aa, Artificial Sequence
  Description of Artificial Sequence: Synthetic peptide
  XENP022846 vhCDR1
HYFMH

SEQ ID NO: 2708 - protein, 17 aa, Artificial Sequence
  Description of Artificial Sequence: Synthetic peptide
  XENP022846 vhCDR2
WIDPYLGDTEYAPKFQG

SEQ ID NO: 2709 - protein, 9 aa, Artificial Sequence
  Description of Artificial Sequence: Synthetic peptide
  XENP022846 vhCDR3
RGVYQALDY

SEQ ID NO: 2710 - protein, 477 aa, Artificial Sequence; identical to SEQ ID NO: 2610
  Description of Artificial Sequence: Synthetic polypeptide
  XENP022846 2A11_H1.125_L2.126_Fab-[CTLA-4]_H3.23_L0.129_scFv scFv-Fc Heavy Chain

SEQ ID NO: 2711 - protein, 118 aa, Artificial Sequence; identical to SEQ ID NO: 2395
  Description of Artificial Sequence: Synthetic polypeptide
  VH of XENP022846

SEQ ID NO: 2712 - protein, 108 aa, Artificial Sequence; identical to SEQ ID NO: 2396
  Description of Artificial Sequence: Synthetic polypeptide
  VL of XENP022846

SEQ ID NO: 2713 - protein, 231 aa, Artificial Sequence; identical to SEQ ID NO: 2409
  Description of Artificial Sequence: Synthetic polypeptide
  Fc chain of XENP022846

SEQ ID NO: 2714 - protein, 5 aa, Artificial Sequence
  Description of Artificial Sequence: Synthetic peptide
  XENP022846 vhCDR1
SYTMH

SEQ ID NO: 2715 - protein, 17 aa, Artificial Sequence
  Description of Artificial Sequence: Synthetic peptide
  XENP022846 vhCDR2
FISYDGNYKYYADSVKG

SEQ ID NO: 2716 - protein, 9 aa, Artificial Sequence
  Description of Artificial Sequence: Synthetic peptide
  XENP022846 vhCDR3
GGHLGPFDL

SEQ ID NO: 2717 - protein, 12 aa, Artificial Sequence
  Description of Artificial Sequence: Synthetic peptide
  XENP022846 vlCDR1
RASQSVGSSYLA

SEQ ID NO: 2718 - protein, 7 aa, Artificial Sequence
  Description of Artificial Sequence: Synthetic peptide
  XENP022846 vlCDR2
GASSRAT

SEQ ID NO: 2719 - protein, 9 aa, Artificial Sequence
  Description of Artificial Sequence: Synthetic peptide
  XENP022846 vlCDR3
QQYGSSPWT

SEQ ID NO: 2720 - protein, 214 aa, Artificial Sequence
  Description of Artificial Sequence: Synthetic polypeptide
  XENP022846 2A11_H1.125_L2.126_Fab-[CTLA-4]_H3.23_L0.129_scFv Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2721 - protein, 107 aa, Artificial Sequence
  Description of Artificial Sequence: Synthetic polypeptide
  VL of XENP022846
DIQMTQSPAFLSVTPGEKVTITCQASQDIGNYLNWFQQKPDQTVKLLIYFTSYLHSGVPSRFSGSGSGTDYTFTISSLEAEDAATYFCQEGNTLPYTFGGGTKVEIK

SEQ ID NO: 2722 - protein, 11 aa, Artificial Sequence
  Description of Artificial Sequence: Synthetic peptide
  XENP022846 vlCDR1
QASQDIGNYLN

SEQ ID NO: 2723 - protein, 7 aa, Artificial Sequence
  Description of Artificial Sequence: Synthetic peptide
  XENP022846 vlCDR2
FTSYLHS

SEQ ID NO: 2724 - protein, 9 aa, Artificial Sequence
  Description of Artificial Sequence: Synthetic peptide
  XENP022846 vlCDR3
QEGNTLPYT

SEQ ID NO: 2725 - protein, 450 aa, Artificial Sequence
  Description of Artificial Sequence: Synthetic polypeptide
  XENP023223 7G8_H3.66_L1.34_Fab-[CTLA-4]_H3.23_L0.129_scFv Fab -Fc Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2726 - protein, 121 aa, Artificial Sequence; identical to SEQ ID NO: 2416
  Description of Artificial Sequence: Synthetic polypeptide
  VH of XENP023223

SEQ ID NO: 2727 - protein, 5 aa, Artificial Sequence
  Description of Artificial Sequence: Synthetic peptide
  XENP023223 vhCDR1
EAWMS

SEQ ID NO: 2728 - protein, 19 aa, Artificial Sequence
  Description of Artificial Sequence: Synthetic peptide
  XENP023223 vhCDR2
EISTKANNHATYYAESVKG

SEQ ID NO: 2729 - protein, 10 aa, Artificial Sequence
  Description of Artificial Sequence: Synthetic peptide
  XENP023223 vhCDR3
LATWDWYFDV

SEQ ID NO: 2730 - protein, 477 aa, Artificial Sequence; identical to SEQ ID NO: 2394
  Description of Artificial Sequence: Synthetic polypeptide
  XENP023223 7G8_H3.66_L1.34_Fab-[CTLA-4]_H3.23_L0.129_scFv scFv -Fc Heavy Chain

SEQ ID NO: 2731 - protein, 118 aa, Artificial Sequence; identical to SEQ ID NO: 2395
  Description of Artificial Sequence: Synthetic polypeptide
  VH of XENP023223

SEQ ID NO: 2732 - protein, 108 aa, Artificial Sequence; identical to SEQ ID NO: 2396
  Description of Artificial Sequence: Synthetic polypeptide
  VL of XENP023223

SEQ ID NO: 2733 - protein, 231 aa, Artificial Sequence; identical to SEQ ID NO: 2397
  Description of Artificial Sequence: Synthetic polypeptide
  Fc chain of XENP023223

SEQ ID NO: 2734 - protein, 5 aa, Artificial Sequence
  Description of Artificial Sequence: Synthetic peptide
  XENP023223 vhCDR1
SYTMH

SEQ ID NO: 2735 - protein, 17 aa, Artificial Sequence
  Description of Artificial Sequence: Synthetic peptide
  XENP023223 vhCDR2
FISYDGNYKYYADSVKG

SEQ ID NO: 2736 - protein, 9 aa, Artificial Sequence
  Description of Artificial Sequence: Synthetic peptide
  XENP023223 vhCDR3
GGHLGPFDL

SEQ ID NO: 2737 - protein, 12 aa, Artificial Sequence
  Description of Artificial Sequence: Synthetic peptide
  XENP023223 vlCDR1
RASQSVGSSYLA

SEQ ID NO: 2738 - protein, 7 aa, Artificial Sequence
  Description of Artificial Sequence: Synthetic peptide
  XENP023223 vlCDR2
GASSRAT

SEQ ID NO: 2739 - protein, 9 aa, Artificial Sequence
  Description of Artificial Sequence: Synthetic peptide
  XENP023223 vlCDR3
QQYGSSPWT

SEQ ID NO: 2740 - protein, 218 aa, Artificial Sequence; identical to SEQ ID NO: 2420
  Description of Artificial Sequence: Synthetic polypeptide
  XENP023223 7G8_H3.66_L1.34_Fab-[CTLA-4]_H3.23_L0.129_scFv Light Chain

SEQ ID NO: 2741 - protein, 111 aa, Artificial Sequence; identical to SEQ ID NO: 2421
  Description of Artificial Sequence: Synthetic polypeptide
  VL of XENP023223

SEQ ID NO: 2742 - protein, 15 aa, Artificial Sequence
  Description of Artificial Sequence: Synthetic peptide
  XENP023223 vlCDR1
RASQSVDYDGDSYMN

SEQ ID NO: 2743 - protein, 7 aa, Artificial Sequence
  Description of Artificial Sequence: Synthetic peptide
  XENP023223 vlCDR2
AASELES

SEQ ID NO: 2744 - protein, 9 aa, Artificial Sequence
  Description of Artificial Sequence: Synthetic peptide
  XENP023223 vlCDR3
QQSNEDPFT

SEQ ID NO: 2745 - protein, 450 aa, Artificial Sequence
  Description of Artificial Sequence: Synthetic polypeptide
  XENP023224 7G8_H3.67_L1.34_Fab-[CTLA-4]_H3.23_L0.129_scFv Fab -Fc Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2746 - protein, 121 aa, Artificial Sequence; identical to SEQ ID NO: 2426
  Description of Artificial Sequence: Synthetic polypeptide
  VH of XENP023224

SEQ ID NO: 2747 - protein, 5 aa, Artificial Sequence
  Description of Artificial Sequence: Synthetic peptide
  XENP023224 vhCDR1
DTWMS

SEQ ID NO: 2748 - protein, 19 aa, Artificial Sequence
  Description of Artificial Sequence: Synthetic peptide
  XENP023224 vhCDR2
EISTKANNHATYYAESVKG

SEQ ID NO: 2749 - protein, 10 aa, Artificial Sequence
  Description of Artificial Sequence: Synthetic peptide
  XENP023224 vhCDR3
LATWDWYFDV

SEQ ID NO: 2750 - protein, 477 aa, Artificial Sequence; identical to SEQ ID NO: 2394
  Description of Artificial Sequence: Synthetic polypeptide
  XENP023224 7G8_H3.67_L1.34_Fab-[CTLA-4]_H3.23_L0.129_scFv scFv -Fc Heavy Chain

SEQ ID NO: 2751 - protein, 118 aa, Artificial Sequence; identical to SEQ ID NO: 2395
  Description of Artificial Sequence: Synthetic polypeptide
  VH of XENP023224

SEQ ID NO: 2752 - protein, 108 aa, Artificial Sequence; identical to SEQ ID NO: 2396
  Description of Artificial Sequence: Synthetic polypeptide
  VL of XENP023224

SEQ ID NO: 2753 - protein, 231 aa, Artificial Sequence; identical to SEQ ID NO: 2397
  Description of Artificial Sequence: Synthetic polypeptide
  Fc chain of XENP023224

SEQ ID NO: 2754 - protein, 5 aa, Artificial Sequence
  Description of Artificial Sequence: Synthetic peptide
  XENP023224 vhCDR1
SYTMH

SEQ ID NO: 2755 - protein, 17 aa, Artificial Sequence
  Description of Artificial Sequence: Synthetic peptide
  XENP023224 vhCDR2
FISYDGNYKYYADSVKG

SEQ ID NO: 2756 - protein, 9 aa, Artificial Sequence
  Description of Artificial Sequence: Synthetic peptide
  XENP023224 vhCDR3
GGHLGPFDL

SEQ ID NO: 2757 - protein, 12 aa, Artificial Sequence
  Description of Artificial Sequence: Synthetic peptide
  XENP023224 vlCDR1
RASQSVGSSYLA

SEQ ID NO: 2758 - protein, 7 aa, Artificial Sequence
  Description of Artificial Sequence: Synthetic peptide
  XENP023224 vlCDR2
GASSRAT

SEQ ID NO: 2759 - protein, 9 aa, Artificial Sequence
  Description of Artificial Sequence: Synthetic peptide
  XENP023224 vlCDR3
QQYGSSPWT

SEQ ID NO: 2760 - protein, 218 aa, Artificial Sequence; identical to SEQ ID NO: 2420
  Description of Artificial Sequence: Synthetic polypeptide
  XENP023224 7G8_H3.67_L1.34_Fab-[CTLA-4]_H3.23_L0.129_scFv Light Chain

SEQ ID NO: 2761 - protein, 111 aa, Artificial Sequence; identical to SEQ ID NO: 2421
  Description of Artificial Sequence: Synthetic polypeptide
  VL of XENP023224

SEQ ID NO: 2762 - protein, 15 aa, Artificial Sequence
  Description of Artificial Sequence: Synthetic peptide
  XENP023224 vlCDR1
RASQSVDYDGDSYMN

SEQ ID NO: 2763 - protein, 7 aa, Artificial Sequence
  Description of Artificial Sequence: Synthetic peptide
  XENP023224 vlCDR2
AASELES

SEQ ID NO: 2764 - protein, 9 aa, Artificial Sequence
  Description of Artificial Sequence: Synthetic peptide
  XENP023224 vlCDR3
QQSNEDPFT

SEQ ID NO: 2765 - protein, 450 aa, Artificial Sequence
  Description of Artificial Sequence: Synthetic polypeptide
  XENP023225 7G8_H3.71_L1.34_Fab-[CTLA-4]_H3.23_L0.129_scFv Fab-Fc Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2766 - protein, 121 aa, Artificial Sequence; identical to SEQ ID NO: 2466
  Description of Artificial Sequence: Synthetic polypeptide
  VH of XENP023225

SEQ ID NO: 2767 - protein, 5 aa, Artificial Sequence
  Description of Artificial Sequence: Synthetic peptide
  XENP023225 vhCDR1
DAWMS

SEQ ID NO: 2768 - protein, 19 aa, Artificial Sequence
  Description of Artificial Sequence: Synthetic peptide
  XENP023225 vhCDR2
EISTKAYNHATYYAESVKG

SEQ ID NO: 2769 - protein, 10 aa, Artificial Sequence
  Description of Artificial Sequence: Synthetic peptide
  XENP023225 vhCDR3
LATWDWYFDV

SEQ ID NO: 2770 - protein, 477 aa, Artificial Sequence; identical to SEQ ID NO: 2394
  Description of Artificial Sequence: Synthetic polypeptide
  XENP023225 7G8_H3.71_L1.34_Fab-[CTLA-4]_H3.23_L0.129_scFv scFv -Fc Heavy Chain

SEQ ID NO: 2771 - protein, 118 aa, Artificial Sequence; identical to SEQ ID NO: 2395
  Description of Artificial Sequence: Synthetic polypeptide
  VH of XENP023225

SEQ ID NO: 2772 - protein, 108 aa, Artificial Sequence; identical to SEQ ID NO: 2396
  Description of Artificial Sequence: Synthetic polypeptide
  VL of XENP023225

SEQ ID NO: 2773 - protein, 231 aa, Artificial Sequence; identical to SEQ ID NO: 2397
  Description of Artificial Sequence: Synthetic polypeptide
  Fc chain of XENP023225

SEQ ID NO: 2774 - protein, 5 aa, Artificial Sequence
  Description of Artificial Sequence: Synthetic peptide
  XENP023225 vhCDR1
SYTMH

SEQ ID NO: 2775 - protein, 17 aa, Artificial Sequence
  Description of Artificial Sequence: Synthetic peptide
  XENP023225 vhCDR2
FISYDGNYKYYADSVKG

SEQ ID NO: 2776 - protein, 9 aa, Artificial Sequence
  Description of Artificial Sequence: Synthetic peptide
  XENP023225 vhCDR3
GGHLGPFDL

SEQ ID NO: 2777 - protein, 12 aa, Artificial Sequence
  Description of Artificial Sequence: Synthetic peptide
  XENP023225 vlCDR1
RASQSVGSSYLA

SEQ ID NO: 2778 - protein, 7 aa, Artificial Sequence
  Description of Artificial Sequence: Synthetic peptide
  XENP023225 vlCDR2
GASSRAT

SEQ ID NO: 2779 - protein, 9 aa, Artificial Sequence
  Description of Artificial Sequence: Synthetic peptide
  XENP023225 vlCDR3
QQYGSSPWT

SEQ ID NO: 2780 - protein, 218 aa, Artificial Sequence; identical to SEQ ID NO: 2420
  Description of Artificial Sequence: Synthetic polypeptide
  XENP023225 7G8_H3.71_L1.34_Fab-[CTLA-4]_H3.23_L0.129_scFv Light Chain

SEQ ID NO: 2781 - protein, 111 aa, Artificial Sequence; identical to SEQ ID NO: 2421
  Description of Artificial Sequence: Synthetic polypeptide
  VL of XENP023225

SEQ ID NO: 2782 - protein, 15 aa, Artificial Sequence
  Description of Artificial Sequence: Synthetic peptide
  XENP023225 vlCDR1
RASQSVDYDGDSYMN

SEQ ID NO: 2783 - protein, 7 aa, Artificial Sequence
  Description of Artificial Sequence: Synthetic peptide
  XENP023225 vlCDR2
AASELES

SEQ ID NO: 2784 - protein, 9 aa, Artificial Sequence
  Description of Artificial Sequence: Synthetic peptide
  XENP023225 vlCDR3
QQSNEDPFT

SEQ ID NO: 2785 - protein, 450 aa, Artificial Sequence
  Description of Artificial Sequence: Synthetic polypeptide
  XENP023226 7G8_H3.30_L1.39_Fab-[CTLA-4]_H3.23_L0.129_scFv Fab- Fc Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2786 - protein, 121 aa, Artificial Sequence; identical to SEQ ID NO: 2516
  Description of Artificial Sequence: Synthetic polypeptide
  VH of XENP023226

SEQ ID NO: 2787 - protein, 5 aa, Artificial Sequence
  Description of Artificial Sequence: Synthetic peptide
  XENP023226 vhCDR1
DAWMS

SEQ ID NO: 2788 - protein, 19 aa, Artificial Sequence
  Description of Artificial Sequence: Synthetic peptide
  XENP023226 vhCDR2
EISTKANNHATYYAESVKG

SEQ ID NO: 2789 - protein, 10 aa, Artificial Sequence
  Description of Artificial Sequence: Synthetic peptide
  XENP023226 vhCDR3
LATWDWYFDV

SEQ ID NO: 2790 - protein, 477 aa, Artificial Sequence; identical to SEQ ID NO: 2394
  Description of Artificial Sequence: Synthetic polypeptide
  XENP023226 7G8_H3.30_L1.39_Fab-[CTLA-4]_H3.23_L0.129_scFv scFv -Fc Heavy Chain

SEQ ID NO: 2791 - protein, 118 aa, Artificial Sequence; identical to SEQ ID NO: 2395
  Description of Artificial Sequence: Synthetic polypeptide
  VH of XENP023226

SEQ ID NO: 2792 - protein, 108 aa, Artificial Sequence; identical to SEQ ID NO: 2396
  Description of Artificial Sequence: Synthetic polypeptide
  VL of XENP023226

SEQ ID NO: 2793 - protein, 231 aa, Artificial Sequence; identical to SEQ ID NO: 2397
  Description of Artificial Sequence: Synthetic polypeptide
  Fc chain of XENP023226

SEQ ID NO: 2794 - protein, 5 aa, Artificial Sequence
  Description of Artificial Sequence: Synthetic peptide
  XENP023226 vhCDR1
SYTMH

SEQ ID NO: 2795 - protein, 17 aa, Artificial Sequence
  Description of Artificial Sequence: Synthetic peptide
  XENP023226 vhCDR2
FISYDGNYKYYADSVKG

SEQ ID NO: 2796 - protein, 9 aa, Artificial Sequence
  Description of Artificial Sequence: Synthetic peptide
  XENP023226 vhCDR3
GGHLGPFDL

SEQ ID NO: 2797 - protein, 12 aa, Artificial Sequence
  Description of Artificial Sequence: Synthetic peptide
  XENP023226 vlCDR1
RASQSVGSSYLA

SEQ ID NO: 2798 - protein, 7 aa, Artificial Sequence
  Description of Artificial Sequence: Synthetic peptide
  XENP023226 vlCDR2
GASSRAT

SEQ ID NO: 2799 - protein, 9 aa, Artificial Sequence
  Description of Artificial Sequence: Synthetic peptide
  XENP023226 vlCDR3
QQYGSSPWT

SEQ ID NO: 2800 - protein, 218 aa, Artificial Sequence; identical to SEQ ID NO: 2530
  Description of Artificial Sequence: Synthetic polypeptide
  XENP023226 7G8_H3.30_L1.39_Fab-[CTLA-4]_H3.23_L0.129_scFv Light Chain

SEQ ID NO: 2801 - protein, 111 aa, Artificial Sequence; identical to SEQ ID NO: 2531
  Description of Artificial Sequence: Synthetic polypeptide
  VL of XENP023226

SEQ ID NO: 2802 - protein, 15 aa, Artificial Sequence
  Description of Artificial Sequence: Synthetic peptide
  XENP023226 vlCDR1
RASQSVDYYGDSYMN

SEQ ID NO: 2803 - protein, 7 aa, Artificial Sequence
  Description of Artificial Sequence: Synthetic peptide
  XENP023226 vlCDR2
AASELES

SEQ ID NO: 2804 - protein, 9 aa, Artificial Sequence
  Description of Artificial Sequence: Synthetic peptide
  XENP023226 vlCDR3
QQSNEDPFT

SEQ ID NO: 2805 - protein, 450 aa, Artificial Sequence; identical to SEQ ID NO: 2725
  Description of Artificial Sequence: Synthetic polypeptide
  XENP023227 7G8_H3.66_L1.39_Fab-[CTLA-4]_H3.23_L0.129_scFv Fab -Fc Heavy Chain

SEQ ID NO: 2806 - protein, 121 aa, Artificial Sequence; identical to SEQ ID NO: 2416
  Description of Artificial Sequence: Synthetic polypeptide
  VH of XENP023227

SEQ ID NO: 2807 - protein, 5 aa, Artificial Sequence
  Description of Artificial Sequence: Synthetic peptide
  XENP023227 vhCDR1
EAWMS

SEQ ID NO: 2808 - protein, 19 aa, Artificial Sequence
  Description of Artificial Sequence: Synthetic peptide
  XENP023227 vhCDR2
EISTKANNHATYYAESVKG

SEQ ID NO: 2809 - protein, 10 aa, Artificial Sequence
  Description of Artificial Sequence: Synthetic peptide
  XENP023227 vhCDR3
LATWDWYFDV

SEQ ID NO: 2810 - protein, 477 aa, Artificial Sequence; identical to SEQ ID NO: 2394
  Description of Artificial Sequence: Synthetic polypeptide
  XENP023227 7G8_H3.66_L1.39_Fab-[CTLA-4]_H3.23_L0.129_scFv scFv -Fc Heavy Chain

SEQ ID NO: 2811 - protein, 118 aa, Artificial Sequence; identical to SEQ ID NO: 2395
  Description of Artificial Sequence: Synthetic polypeptide
  VH of XENP023227

SEQ ID NO: 2812 - protein, 108 aa, Artificial Sequence; identical to SEQ ID NO: 2396
  Description of Artificial Sequence: Synthetic polypeptide
  VL of XENP023227

SEQ ID NO: 2813 - protein, 231 aa, Artificial Sequence; identical to SEQ ID NO: 2397
  Description of Artificial Sequence: Synthetic polypeptide
  Fc chain of XENP023227

SEQ ID NO: 2814 - protein, 5 aa, Artificial Sequence
  Description of Artificial Sequence: Synthetic peptide
  XENP023227 vhCDR1
SYTMH

SEQ ID NO: 2815 - protein, 17 aa, Artificial Sequence
  Description of Artificial Sequence: Synthetic peptide
  XENP023227 vhCDR2
FISYDGNYKYYADSVKG

SEQ ID NO: 2816 - protein, 9 aa, Artificial Sequence
  Description of Artificial Sequence: Synthetic peptide
  XENP023227 vhCDR3
GGHLGPFDL

SEQ ID NO: 2817 - protein, 12 aa, Artificial Sequence
  Description of Artificial Sequence: Synthetic peptide
  XENP023227 vlCDR1
RASQSVGSSYLA

SEQ ID NO: 2818 - protein, 7 aa, Artificial Sequence
  Description of Artificial Sequence: Synthetic peptide
  XENP023227 vlCDR2
GASSRAT

SEQ ID NO: 2819 - protein, 9 aa, Artificial Sequence
  Description of Artificial Sequence: Synthetic peptide
  XENP023227 vlCDR3
QQYGSSPWT

SEQ ID NO: 2820 - protein, 218 aa, Artificial Sequence; identical to SEQ ID NO: 2530
  Description of Artificial Sequence: Synthetic polypeptide
  XENP023227 7G8_H3.66_L1.39_Fab-[CTLA-4]_H3.23_L0.129_scFv Light Chain

SEQ ID NO: 2821 - protein, 111 aa, Artificial Sequence; identical to SEQ ID NO: 2531
  Description of Artificial Sequence: Synthetic polypeptide
  VL of XENP023227

SEQ ID NO: 2822 - protein, 15 aa, Artificial Sequence
  Description of Artificial Sequence: Synthetic peptide
  XENP023227 vlCDR1
RASQSVDYYGDSYMN

SEQ ID NO: 2823 - protein, 7 aa, Artificial Sequence
  Description of Artificial Sequence: Synthetic peptide
  XENP023227 vlCDR2
AASELES

SEQ ID NO: 2824 - protein, 9 aa, Artificial Sequence
  Description of Artificial Sequence: Synthetic peptide
  XENP023227 vlCDR3
QQSNEDPFT

SEQ ID NO: 2825 - protein, 450 aa, Artificial Sequence; identical to SEQ ID NO: 2745
  Description of Artificial Sequence: Synthetic polypeptide
  XENP023228 7G8_H3.67_L1.39_Fab-[CTLA-4]_H3.23_L0.129_scFv Fab- Fc Heavy Chain

SEQ ID NO: 2826 - protein, 121 aa, Artificial Sequence; identical to SEQ ID NO: 2426
  Description of Artificial Sequence: Synthetic polypeptide
  VH of XENP023228

SEQ ID NO: 2827 - protein, 5 aa, Artificial Sequence
  Description of Artificial Sequence: Synthetic peptide
  XENP023228 vhCDR1
DTWMS

SEQ ID NO: 2828 - protein, 19 aa, Artificial Sequence
  Description of Artificial Sequence: Synthetic peptide
  XENP023228 vhCDR2
EISTKANNHATYYAESVKG

SEQ ID NO: 2829 - protein, 10 aa, Artificial Sequence
  Description of Artificial Sequence: Synthetic peptide
  XENP023228 vhCDR3
LATWDWYFDV

SEQ ID NO: 2830 - protein, 477 aa, Artificial Sequence; identical to SEQ ID NO: 2394
  Description of Artificial Sequence: Synthetic polypeptide
  XENP023228 7G8_H3.67_L1.39_Fab-[CTLA-4]_H3.23_L0.129_scFv scFv -Fc Heavy Chain

SEQ ID NO: 2831 - protein, 118 aa, Artificial Sequence; identical to SEQ ID NO: 2395
  Description of Artificial Sequence: Synthetic polypeptide
  VH of XENP023228

SEQ ID NO: 2832 - protein, 108 aa, Artificial Sequence; identical to SEQ ID NO: 2396
  Description of Artificial Sequence: Synthetic polypeptide
  VL of XENP023228

SEQ ID NO: 2833 - protein, 231 aa, Artificial Sequence; identical to SEQ ID NO: 2397
  Description of Artificial Sequence: Synthetic polypeptide
  Fc chain of XENP023228

SEQ ID NO: 2834 - protein, 5 aa, Artificial Sequence
  Description of Artificial Sequence: Synthetic peptide
  XENP023228 vhCDR1
SYTMH

SEQ ID NO: 2835 - protein, 17 aa, Artificial Sequence
  Description of Artificial Sequence: Synthetic peptide
  XENP023228 vhCDR2
FISYDGNYKYYADSVKG

SEQ ID NO: 2836 - protein, 9 aa, Artificial Sequence
  Description of Artificial Sequence: Synthetic peptide
  XENP023228 vhCDR3
GGHLGPFDL

SEQ ID NO: 2837 - protein, 12 aa, Artificial Sequence
  Description of Artificial Sequence: Synthetic peptide
  XENP023228 vlCDR1
RASQSVGSSYLA

SEQ ID NO: 2838 - protein, 7 aa, Artificial Sequence
  Description of Artificial Sequence: Synthetic peptide
  XENP023228 vlCDR2
GASSRAT

SEQ ID NO: 2839 - protein, 9 aa, Artificial Sequence
  Description of Artificial Sequence: Synthetic peptide
  XENP023228 vlCDR3
QQYGSSPWT

SEQ ID NO: 2840 - protein, 218 aa, Artificial Sequence; identical to SEQ ID NO: 2530
  Description of Artificial Sequence: Synthetic polypeptide
  XENP023228 7G8_H3.67_L1.39_Fab-[CTLA-4]_H3.23_L0.129_scFv Light Chain

SEQ ID NO: 2841 - protein, 111 aa, Artificial Sequence; identical to SEQ ID NO: 2531
  Description of Artificial Sequence: Synthetic polypeptide
  VL of XENP023228

SEQ ID NO: 2842 - protein, 15 aa, Artificial Sequence
  Description of Artificial Sequence: Synthetic peptide
  XENP023228 vlCDR1
RASQSVDYYGDSYMN

SEQ ID NO: 2843 - protein, 7 aa, Artificial Sequence
  Description of Artificial Sequence: Synthetic peptide
  XENP023228 vlCDR2
AASELES

SEQ ID NO: 2844 - protein, 9 aa, Artificial Sequence
  Description of Artificial Sequence: Synthetic peptide
  XENP023228 vlCDR3
QQSNEDPFT

SEQ ID NO: 2845 - protein, 450 aa, Artificial Sequence; identical to SEQ ID NO: 2765
  Description of Artificial Sequence: Synthetic polypeptide
  XENP023229 7G8_H3.71_L1.39_Fab-[CTLA-4]_H3.23_L0.129_scFv Fab -Fc Heavy Chain

SEQ ID NO: 2846 - protein, 121 aa, Artificial Sequence; identical to SEQ ID NO: 2466
  Description of Artificial Sequence: Synthetic polypeptide
  VH of XENP023229

SEQ ID NO: 2847 - protein, 5 aa, Artificial Sequence
  Description of Artificial Sequence: Synthetic peptide
  XENP023229 vhCDR1
DAWMS

SEQ ID NO: 2848 - protein, 19 aa, Artificial Sequence
  Description of Artificial Sequence: Synthetic peptide
  XENP023229 vhCDR2
EISTKAYNHATYYAESVKG

SEQ ID NO: 2849 - protein, 10 aa, Artificial Sequence
  Description of Artificial Sequence: Synthetic peptide
  XENP023229 vhCDR3
LATWDWYFDV

SEQ ID NO: 2850 - protein, 477 aa, Artificial Sequence; identical to SEQ ID NO: 2394
  Description of Artificial Sequence: Synthetic polypeptide
  XENP023229 7G8_H3.71_L1.39_Fab-[CTLA-4]_H3.23_L0.129_scFv scFv -Fc Heavy Chain

SEQ ID NO: 2851 - protein, 118 aa, Artificial Sequence; identical to SEQ ID NO: 2395
  Description of Artificial Sequence: Synthetic polypeptide
  VH of XENP023229

SEQ ID NO: 2852 - protein, 108 aa, Artificial Sequence; identical to SEQ ID NO: 2396
  Description of Artificial Sequence: Synthetic polypeptide
  VL of XENP023229

SEQ ID NO: 2853 - protein, 231 aa, Artificial Sequence; identical to SEQ ID NO: 2397
  Description of Artificial Sequence: Synthetic polypeptide
  Fc chain of XENP023229

SEQ ID NO: 2854 - protein, 5 aa, Artificial Sequence
  Description of Artificial Sequence: Synthetic peptide
  XENP023229 vhCDR1
SYTMH

SEQ ID NO: 2855 - protein, 17 aa, Artificial Sequence
  Description of Artificial Sequence: Synthetic peptide
  XENP023229 vhCDR2
FISYDGNYKYYADSVKG

SEQ ID NO: 2856 - protein, 9 aa, Artificial Sequence
  Description of Artificial Sequence: Synthetic peptide
  XENP023229 vhCDR3
GGHLGPFDL

SEQ ID NO: 2857 - protein, 12 aa, Artificial Sequence
  Description of Artificial Sequence: Synthetic peptide
  XENP023229 vlCDR1
RASQSVGSSYLA

SEQ ID NO: 2858 - protein, 7 aa, Artificial Sequence
  Description of Artificial Sequence: Synthetic peptide
  XENP023229 vlCDR2
GASSRAT

SEQ ID NO: 2859 - protein, 9 aa, Artificial Sequence
  Description of Artificial Sequence: Synthetic peptide
  XENP023229 vlCDR3
QQYGSSPWT

SEQ ID NO: 2860 - protein, 218 aa, Artificial Sequence; identical to SEQ ID NO: 2530
  Description of Artificial Sequence: Synthetic polypeptide
  XENP023229 7G8_H3.71_L1.39_Fab-[CTLA-4]_H3.23_L0.129_scFv Light Chain

SEQ ID NO: 2861 - protein, 111 aa, Artificial Sequence; identical to SEQ ID NO: 2531
  Description of Artificial Sequence: Synthetic polypeptide
  VL of XENP023229

SEQ ID NO: 2862 - protein, 15 aa, Artificial Sequence
  Description of Artificial Sequence: Synthetic peptide
  XENP023229 vlCDR1
RASQSVDYYGDSYMN

SEQ ID NO: 2863 - protein, 7 aa, Artificial Sequence
  Description of Artificial Sequence: Synthetic peptide
  XENP023229 vlCDR2
AASELES

SEQ ID NO: 2864 - protein, 9 aa, Artificial Sequence
  Description of Artificial Sequence: Synthetic peptide
  XENP023229 vlCDR3
QQSNEDPFT

SEQ ID NO: 2865 - protein, 447 aa, Artificial Sequence
  Description of Artificial Sequence: Synthetic polypeptide
  XENP022718 2A11_H1.144_L2_Fab-1G6_L1.194_H1.279_scFv Fab-Fc Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2866 - protein, 118 aa, Artificial Sequence; identical to SEQ ID NO: 2646
  Description of Artificial Sequence: Synthetic polypeptide
  VH of XENP022718

SEQ ID NO: 2867 - protein, 5 aa, Artificial Sequence
  Description of Artificial Sequence: Synthetic peptide
  XENP022718 vhCDR1
DYFMH

SEQ ID NO: 2868 - protein, 17 aa, Artificial Sequence
  Description of Artificial Sequence: Synthetic peptide
  XENP022718 vhCDR2
WIDPELGDTEYAPKFQG

SEQ ID NO: 2869 - protein, 9 aa, Artificial Sequence
  Description of Artificial Sequence: Synthetic peptide
  XENP022718 vhCDR3
RGVYQALDY

SEQ ID NO: 2870 - protein, 480 aa, Artificial Sequence
  Description of Artificial Sequence: Synthetic polypeptide
  XENP022718 2A11_H1.144_L2_Fab-1G6_L1.194_H1.279_scFv scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2871 - protein, 107 aa, Artificial Sequence
  Description of Artificial Sequence: Synthetic polypeptide
  VH of XENP022718
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 2872 - protein, 122 aa, Artificial Sequence
  Description of Artificial Sequence: Synthetic polypeptide
  VL of XENP022718
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 2873 - protein, 231 aa, Artificial Sequence; identical to SEQ ID NO: 2397
  Description of Artificial Sequence: Synthetic polypeptide
  Fc chain of XENP022718

SEQ ID NO: 2874 - protein, 11 aa, Artificial Sequence
  Description of Artificial Sequence: Synthetic peptide
  XENP022718 vhCDR1
RASQSVGNDVA

SEQ ID NO: 2875 - protein, 7 aa, Artificial Sequence
  Description of Artificial Sequence: Synthetic peptide
  XENP022718 vhCDR2
YASHRYT

SEQ ID NO: 2876 - protein, 9 aa, Artificial Sequence
  Description of Artificial Sequence: Synthetic peptide
  XENP022718 vhCDR3
QQDFSSPRT

SEQ ID NO: 2877 - protein, 5 aa, Artificial Sequence
  Description of Artificial Sequence: Synthetic peptide
  XENP022718 vlCDR1
NYWMN

SEQ ID NO: 2878 - protein, 19 aa, Artificial Sequence
  Description of Artificial Sequence: Synthetic peptide
  XENP022718 vlCDR2
EIRLYSNNYATHYAESVKG

SEQ ID NO: 2879 - protein, 11 aa, Artificial Sequence
  Description of Artificial Sequence: Synthetic peptide
  XENP022718 vlCDR3
YYGNYGGYFDV

SEQ ID NO: 2880 - protein, 214 aa, Artificial Sequence
  Description of Artificial Sequence: Synthetic polypeptide
  XENP022718 2A11_H1.144_L2_Fab-1G6_L1.194_H1.279_scFv Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2881 - protein, 107 aa, Artificial Sequence
  Description of Artificial Sequence: Synthetic polypeptide
  VL of XENP022718
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPYTFGGGTKVEIK

SEQ ID NO: 2882 - protein, 11 aa, Artificial Sequence
  Description of Artificial Sequence: Synthetic peptide
  XENP022718 vlCDR1
QASQDIGNYLN

SEQ ID NO: 2883 - protein, 7 aa, Artificial Sequence
  Description of Artificial Sequence: Synthetic peptide
  XENP022718 vlCDR2
YTSRLHS

SEQ ID NO: 2884 - protein, 9 aa, Artificial Sequence
  Description of Artificial Sequence: Synthetic peptide
  XENP022718 vlCDR3
QQGNTLPYT

SEQ ID NO: 2885 - protein, 447 aa, Artificial Sequence
  Description of Artificial Sequence: Synthetic polypeptide
  XENP022719 2A11_H1_L2.50_Fab-1G6_L1.194_H1.279_scFv Fab-Fc Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2886 - protein, 118 aa, Artificial Sequence; identical to SEQ ID NO: 2686
  Description of Artificial Sequence: Synthetic polypeptide
  VH of XENP022719

SEQ ID NO: 2887 - protein, 5 aa, Artificial Sequence
  Description of Artificial Sequence: Synthetic peptide
  XENP022719 vhCDR1
DYYMH

SEQ ID NO: 2888 - protein, 17 aa, Artificial Sequence
  Description of Artificial Sequence: Synthetic peptide
  XENP022719 vhCDR2
WIDPENGDTEYAPKFQG

SEQ ID NO: 2889 - protein, 9 aa, Artificial Sequence
  Description of Artificial Sequence: Synthetic peptide
  XENP022719 vhCDR3
RGVRQALDY

SEQ ID NO: 2890 - protein, 480 aa, Artificial Sequence; identical to SEQ ID NO: 2870
  Description of Artificial Sequence: Synthetic polypeptide
  XENP022719 2A11_H1_L2.50_Fab-1G6_L1.194_H1.279_scFv scFv-Fc Heavy Chain

SEQ ID NO: 2891 - protein, 107 aa, Artificial Sequence; identical to SEQ ID NO: 2871
  Description of Artificial Sequence: Synthetic polypeptide
  VH of XENP022719

SEQ ID NO: 2892 - protein, 122 aa, Artificial Sequence; identical to SEQ ID NO: 2872
  Description of Artificial Sequence: Synthetic polypeptide
  VL of XENP022719

SEQ ID NO: 2893 - protein, 231 aa, Artificial Sequence; identical to SEQ ID NO: 2397
  Description of Artificial Sequence: Synthetic polypeptide
  Fc chain of XENP022719

SEQ ID NO: 2894 - protein, 11 aa, Artificial Sequence
  Description of Artificial Sequence: Synthetic peptide
  XENP022719 vhCDR1
RASQSVGNDVA

SEQ ID NO: 2895 - protein, 7 aa, Artificial Sequence
  Description of Artificial Sequence: Synthetic peptide
  XENP022719 vhCDR2
YASHRYT

SEQ ID NO: 2896 - protein, 9 aa, Artificial Sequence
  Description of Artificial Sequence: Synthetic peptide
  XENP022719 vhCDR3
QQDFSSPRT

SEQ ID NO: 2897 - protein, 5 aa, Artificial Sequence
  Description of Artificial Sequence: Synthetic peptide
  XENP022719 vlCDR1
NYWMN

SEQ ID NO: 2898 - protein, 19 aa, Artificial Sequence
  Description of Artificial Sequence: Synthetic peptide
  XENP022719 vlCDR2
EIRLYSNNYATHYAESVKG

SEQ ID NO: 2899 - protein, 11 aa, Artificial Sequence
  Description of Artificial Sequence: Synthetic peptide
  XENP022719 vlCDR3
YYGNYGGYFDV

SEQ ID NO: 2900 - protein, 214 aa, Artificial Sequence
  Description of Artificial Sequence: Synthetic polypeptide
  XENP022719 2A11_H1_L2.50_Fab-1G6_L1.194_H1.279_scFv Light Chain
DIQMTQSPAFLSVTPGEKVTITCQASQDIGNYLNWFQQKPDQTVKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2901 - protein, 107 aa, Artificial Sequence
  Description of Artificial Sequence: Synthetic polypeptide
  VL of XENP022719
DIQMTQSPAFLSVTPGEKVTITCQASQDIGNYLNWFQQKPDQTVKLLIYYTSYLHSGVPSRFSGSGSGTDYTFTISSLEAEDAATYFCQQGNTLPYTFGGGTKVEIK

SEQ ID NO: 2902 - protein, 11 aa, Artificial Sequence
  Description of Artificial Sequence: Synthetic peptide
  XENP022719 vlCDR1
QASQDIGNYLN

SEQ ID NO: 2903 - protein, 7 aa, Artificial Sequence
  Description of Artificial Sequence: Synthetic peptide
  XENP022719 vlCDR2
YTSYLHS

SEQ ID NO: 2904 - protein, 9 aa, Artificial Sequence
  Description of Artificial Sequence: Synthetic peptide
  XENP022719 vlCDR3
QQGNTLPYT

SEQ ID NO: 2905 - protein, 447 aa, Artificial Sequence; identical to SEQ ID NO: 2885
  Description of Artificial Sequence: Synthetic polypeptide
  XENP022720 2A11_H1_L2.113_Fab-1G6_L1.194_H1.279_scFv Fab-Fc Heavy Chain

SEQ ID NO: 2906 - protein, 118 aa, Artificial Sequence; identical to SEQ ID NO: 2686
  Description of Artificial Sequence: Synthetic polypeptide
  VH of XENP022720

SEQ ID NO: 2907 - protein, 5 aa, Artificial Sequence
  Description of Artificial Sequence: Synthetic peptide
  XENP022720 vhCDR1
DYYMH

SEQ ID NO: 2908 - protein, 17 aa, Artificial Sequence
  Description of Artificial Sequence: Synthetic peptide
  XENP022720 vhCDR2
WIDPENGDTEYAPKFQG

SEQ ID NO: 2909 - protein, 9 aa, Artificial Sequence
  Description of Artificial Sequence: Synthetic peptide
  XENP022720 vhCDR3
RGVRQALDY

SEQ ID NO: 2910 - protein, 480 aa, Artificial Sequence; identical to SEQ ID NO: 2870
  Description of Artificial Sequence: Synthetic polypeptide
  XENP022720 2A11_H1_L2.113_Fab-1G6_L1.194_H1.279_scFv scFv-Fc Heavy Chain

SEQ ID NO: 2911 - protein, 107 aa, Artificial Sequence; identical to SEQ ID NO: 2871
  Description of Artificial Sequence: Synthetic polypeptide
  VH of XENP022720

SEQ ID NO: 2912 - protein, 122 aa, Artificial Sequence; identical to SEQ ID NO: 2872
  Description of Artificial Sequence: Synthetic polypeptide
  VL of XENP022720

SEQ ID NO: 2913 - protein, 231 aa, Artificial Sequence; identical to SEQ ID NO: 2397
  Description of Artificial Sequence: Synthetic polypeptide
  Fc chain of XENP022720

SEQ ID NO: 2914 - protein, 11 aa, Artificial Sequence
  Description of Artificial Sequence: Synthetic peptide
  XENP022720 vhCDR1
RASQSVGNDVA

SEQ ID NO: 2915 - protein, 7 aa, Artificial Sequence
  Description of Artificial Sequence: Synthetic peptide
  XENP022720 vhCDR2
YASHRYT

SEQ ID NO: 2916 - protein, 9 aa, Artificial Sequence
  Description of Artificial Sequence: Synthetic peptide
  XENP022720 vhCDR3
QQDFSSPRT

SEQ ID NO: 2917 - protein, 5 aa, Artificial Sequence
  Description of Artificial Sequence: Synthetic peptide
  XENP022720 vlCDR1
NYWMN

SEQ ID NO: 2918 - protein, 19 aa, Artificial Sequence
  Description of Artificial Sequence: Synthetic peptide
  XENP022720 vlCDR2
EIRLYSNNYATHYAESVKG

SEQ ID NO: 2919 - protein, 11 aa, Artificial Sequence
  Description of Artificial Sequence: Synthetic peptide
  XENP022720 vlCDR3
YYGNYGGYFDV

SEQ ID NO: 2920 - protein, 214 aa, Artificial Sequence; identical to SEQ ID NO: 2680
  Description of Artificial Sequence: Synthetic polypeptide
  XENP022720 2A11_H1_L2.113_Fab-1G6_L1.194_H1.279_scFv Light Chain

SEQ ID NO: 2921 - protein, 107 aa, Artificial Sequence; identical to SEQ ID NO: 2681
  Description of Artificial Sequence: Synthetic polypeptide
  VL of XENP022720

SEQ ID NO: 2922 - protein, 11 aa, Artificial Sequence
  Description of Artificial Sequence: Synthetic peptide
  XENP022720 vlCDR1
QASQDIGNYLN

SEQ ID NO: 2923 - protein, 7 aa, Artificial Sequence
  Description of Artificial Sequence: Synthetic peptide
  XENP022720 vlCDR2
FTSYLHS

SEQ ID NO: 2924 - protein, 9 aa, Artificial Sequence
  Description of Artificial Sequence: Synthetic peptide
  XENP022720 vlCDR3
QQGNTLPYT

SEQ ID NO: 2925 - protein, 450 aa, Artificial Sequence; identical to SEQ ID NO: 2605
  Description of Artificial Sequence: Synthetic polypeptide
  XENP022847 7G8_H3.30_L1.34_Fab-1G6_L1.194_H1.279_scFv Fab-Fc Heavy Chain

SEQ ID NO: 2926 - protein, 121 aa, Artificial Sequence; identical to SEQ ID NO: 2516
  Description of Artificial Sequence: Synthetic polypeptide
  VH of XENP022847

SEQ ID NO: 2927 - protein, 5 aa, Artificial Sequence
  Description of Artificial Sequence: Synthetic peptide
  XENP022847 vhCDR1
DAWMS

SEQ ID NO: 2928 - protein, 19 aa, Artificial Sequence
  Description of Artificial Sequence: Synthetic peptide
  XENP022847 vhCDR2
EISTKANNHATYYAESVKG

SEQ ID NO: 2929 - protein, 10 aa, Artificial Sequence
  Description of Artificial Sequence: Synthetic peptide
  XENP022847 vhCDR3
LATWDWYFDV

SEQ ID NO: 2930 - protein, 480 aa, Artificial Sequence
  Description of Artificial Sequence: Synthetic polypeptide
  XENP022847 7G8_H3.30_L1.34_Fab-1G6_L1.194_H1.279_scFv scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2931 - protein, 107 aa, Artificial Sequence; identical to SEQ ID NO: 2871
  Description of Artificial Sequence: Synthetic polypeptide
  VH of XENP022847

SEQ ID NO: 2932 - protein, 122 aa, Artificial Sequence; identical to SEQ ID NO: 2872
  Description of Artificial Sequence: Synthetic polypeptide
  VL of XENP022847

SEQ ID NO: 2933 - protein, 231 aa, Artificial Sequence; identical to SEQ ID NO: 2409
  Description of Artificial Sequence: Synthetic polypeptide
  Fc chain of XENP022847

SEQ ID NO: 2934 - protein, 11 aa, Artificial Sequence
  Description of Artificial Sequence: Synthetic peptide
  XENP022847 vhCDR1
RASQSVGNDVA

SEQ ID NO: 2935 - protein, 7 aa, Artificial Sequence
  Description of Artificial Sequence: Synthetic peptide
  XENP022847 vhCDR2
YASHRYT

SEQ ID NO: 2936 - protein, 9 aa, Artificial Sequence
  Description of Artificial Sequence: Synthetic peptide
  XENP022847 vhCDR3
QQDFSSPRT

SEQ ID NO: 2937 - protein, 5 aa, Artificial Sequence
  Description of Artificial Sequence: Synthetic peptide
  XENP022847 vlCDR1
NYWMN

SEQ ID NO: 2938 - protein, 19 aa, Artificial Sequence
  Description of Artificial Sequence: Synthetic peptide
  XENP022847 vlCDR2
EIRLYSNNYATHYAESVKG

SEQ ID NO: 2939 - protein, 11 aa, Artificial Sequence
  Description of Artificial Sequence: Synthetic peptide
  XENP022847 vlCDR3
YYGNYGGYFDV

SEQ ID NO: 2940 - protein, 218 aa, Artificial Sequence; identical to SEQ ID NO: 2420
  Description of Artificial Sequence: Synthetic polypeptide
  XENP022847 7G8_H3.30_L1.34_Fab-1G6_L1.194_H1.279_scFv Light Chain

SEQ ID NO: 2941 - protein, 111 aa, Artificial Sequence; identical to SEQ ID NO: 2421
  Description of Artificial Sequence: Synthetic polypeptide
  VL of XENP022847

SEQ ID NO: 2942 - protein, 15 aa, Artificial Sequence
  Description of Artificial Sequence: Synthetic peptide
  XENP022847 vlCDR1
RASQSVDYDGDSYMN

SEQ ID NO: 2943 - protein, 7 aa, Artificial Sequence
  Description of Artificial Sequence: Synthetic peptide
  XENP022847 vlCDR2
AASELES

SEQ ID NO: 2944 - protein, 9 aa, Artificial Sequence
  Description of Artificial Sequence: Synthetic peptide
  XENP022847 vlCDR3
QQSNEDPFT

SEQ ID NO: 2945 - protein, 450 aa, Artificial Sequence; identical to SEQ ID NO: 2605
  Description of Artificial Sequence: Synthetic polypeptide
  XENP022848 7G8_H3.30_L1.36_Fab-1G6_L1.194_H1.279_scFv Fab-Fc Heavy Chain

SEQ ID NO: 2946 - protein, 121 aa, Artificial Sequence; identical to SEQ ID NO: 2516
  Description of Artificial Sequence: Synthetic polypeptide
  VH of XENP022848

SEQ ID NO: 2947 - protein, 5 aa, Artificial Sequence
  Description of Artificial Sequence: Synthetic peptide
  XENP022848 vhCDR1
DAWMS

SEQ ID NO: 2948 - protein, 19 aa, Artificial Sequence
  Description of Artificial Sequence: Synthetic peptide
  XENP022848 vhCDR2
EISTKANNHATYYAESVKG

SEQ ID NO: 2949 - protein, 10 aa, Artificial Sequence
  Description of Artificial Sequence: Synthetic peptide
  XENP022848 vhCDR3
LATWDWYFDV

SEQ ID NO: 2950 - protein, 480 aa, Artificial Sequence; identical to SEQ ID NO: 2930
  Description of Artificial Sequence: Synthetic polypeptide
  XENP022848 7G8_H3.30_L1.36_Fab-1G6_L1.194_H1.279_scFv scFv-Fc Heavy Chain

SEQ ID NO: 2951 - protein, 107 aa, Artificial Sequence; identical to SEQ ID NO: 2871
  Description of Artificial Sequence: Synthetic polypeptide
  VH of XENP022848

SEQ ID NO: 2952 - protein, 122 aa, Artificial Sequence; identical to SEQ ID NO: 2872
  Description of Artificial Sequence: Synthetic polypeptide
  VL of XENP022848

SEQ ID NO: 2953 - protein, 231 aa, Artificial Sequence; identical to SEQ ID NO: 2409
  Description of Artificial Sequence: Synthetic polypeptide
  Fc chain of XENP022848

SEQ ID NO: 2954 - protein, 11 aa, Artificial Sequence
  Description of Artificial Sequence: Synthetic peptide
  XENP022848 vhCDR1
RASQSVGNDVA

SEQ ID NO: 2955 - protein, 7 aa, Artificial Sequence
  Description of Artificial Sequence: Synthetic peptide
  XENP022848 vhCDR2
YASHRYT

SEQ ID NO: 2956 - protein, 9 aa, Artificial Sequence
  Description of Artificial Sequence: Synthetic peptide
  XENP022848 vhCDR3
QQDFSSPRT

SEQ ID NO: 2957 - protein, 5 aa, Artificial Sequence
  Description of Artificial Sequence: Synthetic peptide
  XENP022848 vlCDR1
NYWMN

SEQ ID NO: 2958 - protein, 19 aa, Artificial Sequence
  Description of Artificial Sequence: Synthetic peptide
  XENP022848 vlCDR2
EIRLYSNNYATHYAESVKG

SEQ ID NO: 2959 - protein, 11 aa, Artificial Sequence
  Description of Artificial Sequence: Synthetic peptide
  XENP022848 vlCDR3
YYGNYGGYFDV

SEQ ID NO: 2960 - protein, 218 aa, Artificial Sequence; identical to SEQ ID NO: 2640
  Description of Artificial Sequence: Synthetic polypeptide
  XENP022848 7G8_H3.30_L1.36_Fab-1G6_L1.194_H1.279_scFv Light Chain

SEQ ID NO: 2961 - protein, 111 aa, Artificial Sequence; identical to SEQ ID NO: 2641
  Description of Artificial Sequence: Synthetic polypeptide
  VL of XENP022848

SEQ ID NO: 2962 - protein, 15 aa, Artificial Sequence
  Description of Artificial Sequence: Synthetic peptide
  XENP022848 vlCDR1
RASQSVDHDGDSYMN

SEQ ID NO: 2963 - protein, 7 aa, Artificial Sequence
  Description of Artificial Sequence: Synthetic peptide
  XENP022848 vlCDR2
AASELES

SEQ ID NO: 2964 - protein, 9 aa, Artificial Sequence
  Description of Artificial Sequence: Synthetic peptide
  XENP022848 vlCDR3
QQSNEDPFT

SEQ ID NO: 2965 - protein, 447 aa, Artificial Sequence; identical to SEQ ID NO: 2645
  Description of Artificial Sequence: Synthetic polypeptide
  XENP022849 2A11_H1.144_L2.142_Fab-1G6_L1.194_H1.279_scFv Fab-Fc Heavy Chain

SEQ ID NO: 2966 - protein, 118 aa, Artificial Sequence; identical to SEQ ID NO: 2646
  Description of Artificial Sequence: Synthetic polypeptide
  VH of XENP022849

SEQ ID NO: 2967 - protein, 5 aa, Artificial Sequence
  Description of Artificial Sequence: Synthetic peptide
  XENP022849 vhCDR1
DYFMH

SEQ ID NO: 2968 - protein, 17 aa, Artificial Sequence
  Description of Artificial Sequence: Synthetic peptide
  XENP022849 vhCDR2
WIDPELGDTEYAPKFQG

SEQ ID NO: 2969 - protein, 9 aa, Artificial Sequence
  Description of Artificial Sequence: Synthetic peptide
  XENP022849 vhCDR3
RGVYQALDY

SEQ ID NO: 2970 - protein, 480 aa, Artificial Sequence; identical to SEQ ID NO: 2930
  Description of Artificial Sequence: Synthetic polypeptide
  XENP022849 2A11_H1.144_L2.142_Fab-1G6_L1.194_H1.279_scFv scFv-Fc Heavy Chain

SEQ ID NO: 2971 - protein, 107 aa, Artificial Sequence; identical to SEQ ID NO: 2871
  Description of Artificial Sequence: Synthetic polypeptide
  VH of XENP022849

SEQ ID NO: 2972 - protein, 122 aa, Artificial Sequence; identical to SEQ ID NO: 2872
  Description of Artificial Sequence: Synthetic polypeptide
  VL of XENP022849

SEQ ID NO: 2973 - protein, 231 aa, Artificial Sequence; identical to SEQ ID NO: 2409
  Description of Artificial Sequence: Synthetic polypeptide
  Fc chain of XENP022849

SEQ ID NO: 2974 - protein, 11 aa, Artificial Sequence
  Description of Artificial Sequence: Synthetic peptide
  XENP022849 vhCDR1
RASQSVGNDVA

SEQ ID NO: 2975 - protein, 7 aa, Artificial Sequence
  Description of Artificial Sequence: Synthetic peptide
  XENP022849 vhCDR2
YASHRYT

SEQ ID NO: 2976 - protein, 9 aa, Artificial Sequence
  Description of Artificial Sequence: Synthetic peptide
  XENP022849 vhCDR3
QQDFSSPRT

SEQ ID NO: 2977 - protein, 5 aa, Artificial Sequence
  Description of Artificial Sequence: Synthetic peptide
  XENP022849 vlCDR1
NYWMN

SEQ ID NO: 2978 - protein, 19 aa, Artificial Sequence
  Description of Artificial Sequence: Synthetic peptide
  XENP022849 vlCDR2
EIRLYSNNYATHYAESVKG

SEQ ID NO: 2979 - protein, 11 aa, Artificial Sequence
  Description of Artificial Sequence: Synthetic peptide
  XENP022849 vlCDR3
YYGNYGGYFDV

SEQ ID NO: 2980 - protein, 214 aa, Artificial Sequence; identical to SEQ ID NO: 2660
  Description of Artificial Sequence: Synthetic polypeptide
  XENP022849 2A11_H1.144_L2.142_Fab-1G6_L1.194_H1.279_scFv Light Chain

SEQ ID NO: 2981 - protein, 107 aa, Artificial Sequence; identical to SEQ ID NO: 2661
  Description of Artificial Sequence: Synthetic polypeptide
  VL of XENP022849

SEQ ID NO: 2982 - protein, 11 aa, Artificial Sequence
  Description of Artificial Sequence: Synthetic peptide
  XENP022849 vlCDR1
QASQDIGNYLN

SEQ ID NO: 2983 - protein, 7 aa, Artificial Sequence
  Description of Artificial Sequence: Synthetic peptide
  XENP022849 vlCDR2
FTSYLHS

SEQ ID NO: 2984 - protein, 9 aa, Artificial Sequence
  Description of Artificial Sequence: Synthetic peptide
  XENP022849 vlCDR3
QQGNTLPYT

SEQ ID NO: 2985 - protein, 447 aa, Artificial Sequence; identical to SEQ ID NO: 2645
  Description of Artificial Sequence: Synthetic polypeptide
  XENP022850 2A11_H1.144_L2.113_Fab-1G6_L1.194_H1.279_scFv Fab -Fc Heavy Chain

SEQ ID NO: 2986 - protein, 118 aa, Artificial Sequence; identical to SEQ ID NO: 2646
  Description of Artificial Sequence: Synthetic polypeptide
  VH of XENP022850

SEQ ID NO: 2987 - protein, 5 aa, Artificial Sequence
  Description of Artificial Sequence: Synthetic peptide
  XENP022850 vhCDR1
DYFMH

SEQ ID NO: 2988 - protein, 17 aa, Artificial Sequence
  Description of Artificial Sequence: Synthetic peptide
  XENP022850 vhCDR2
WIDPELGDTEYAPKFQG

SEQ ID NO: 2989 - protein, 9 aa, Artificial Sequence
  Description of Artificial Sequence: Synthetic peptide
  XENP022850 vhCDR3
RGVYQALDY

SEQ ID NO: 2990 - protein, 480 aa, Artificial Sequence; identical to SEQ ID NO: 2930
  Description of Artificial Sequence: Synthetic polypeptide
  XENP022850 2A11_H1.144_L2.113_Fab-1G6_L1.194_H1.279_scFv scFv -Fc Heavy Chain

SEQ ID NO: 2991 - protein, 107 aa, Artificial Sequence; identical to SEQ ID NO: 2871
  Description of Artificial Sequence: Synthetic polypeptide
  VH of XENP022850

SEQ ID NO: 2992 - protein, 122 aa, Artificial Sequence; identical to SEQ ID NO: 2872
  Description of Artificial Sequence: Synthetic polypeptide
  VL of XENP022850

SEQ ID NO: 2993 - protein, 231 aa, Artificial Sequence; identical to SEQ ID NO: 2409
  Description of Artificial Sequence: Synthetic polypeptide
  Fc chain of XENP022850

SEQ ID NO: 2994 - protein, 11 aa, Artificial Sequence
  Description of Artificial Sequence: Synthetic peptide
  XENP022850 vhCDR1
RASQSVGNDVA

SEQ ID NO: 2995 - protein, 7 aa, Artificial Sequence
  Description of Artificial Sequence: Synthetic peptide
  XENP022850 vhCDR2
YASHRYT

SEQ ID NO: 2996 - protein, 9 aa, Artificial Sequence
  Description of Artificial Sequence: Synthetic peptide
  XENP022850 vhCDR3
QQDFSSPRT

SEQ ID NO: 2997 - protein, 5 aa, Artificial Sequence
  Description of Artificial Sequence: Synthetic peptide
  XENP022850 vlCDR1
NYWMN

SEQ ID NO: 2998 - protein, 19 aa, Artificial Sequence
  Description of Artificial Sequence: Synthetic peptide
  XENP022850 vlCDR2
EIRLYSNNYATHYAESVKG

SEQ ID NO: 2999 - protein, 11 aa, Artificial Sequence
  Description of Artificial Sequence: Synthetic peptide
  XENP022850 vlCDR3
YYGNYGGYFDV

SEQ ID NO: 3000 - protein, 214 aa, Artificial Sequence; identical to SEQ ID NO: 2680
  Description of Artificial Sequence: Synthetic polypeptide
  XENP022850 2A11_H1.144_L2.113_Fab-1G6_L1.194_H1.279_scFv Light Chain

SEQ ID NO: 3001 - protein, 107 aa, Artificial Sequence; identical to SEQ ID NO: 2681
  Description of Artificial Sequence: Synthetic polypeptide
  VL of XENP022850

SEQ ID NO: 3002 - protein, 11 aa, Artificial Sequence
  Description of Artificial Sequence: Synthetic peptide
  XENP022850 vlCDR1
QASQDIGNYLN

SEQ ID NO: 3003 - protein, 7 aa, Artificial Sequence
  Description of Artificial Sequence: Synthetic peptide
  XENP022850 vlCDR2
FTSYLHS

SEQ ID NO: 3004 - protein, 9 aa, Artificial Sequence
  Description of Artificial Sequence: Synthetic peptide
  XENP022850 vlCDR3
QQGNTLPYT

SEQ ID NO: 3005 - protein, 447 aa, Artificial Sequence; identical to SEQ ID NO: 2705
  Description of Artificial Sequence: Synthetic polypeptide
  XENP022851 2A11_H1.125_L2.126_Fab-1G6_L1.194_H1.279_scFv Fab-Fc Heavy Chain

SEQ ID NO: 3006 - protein, 118 aa, Artificial Sequence; identical to SEQ ID NO: 2706
  Description of Artificial Sequence: Synthetic polypeptide
  VH of XENP022851

SEQ ID NO: 3007 - protein, 5 aa, Artificial Sequence
  Description of Artificial Sequence: Synthetic peptide
  XENP022851 vhCDR1
HYFMH

SEQ ID NO: 3008 - protein, 17 aa, Artificial Sequence
  Description of Artificial Sequence: Synthetic peptide
  XENP022851 vhCDR2
WIDPYLGDTEYAPKFQG

SEQ ID NO: 3009 - protein, 9 aa, Artificial Sequence
  Description of Artificial Sequence: Synthetic peptide
  XENP022851 vhCDR3
RGVYQALDY

SEQ ID NO: 3010 - protein, 480 aa, Artificial Sequence; identical to SEQ ID NO: 2930
  Description of Artificial Sequence: Synthetic polypeptide
  XENP022851 2A11_H1.125_L2.126_Fab-1G6_L1.194_H1.279_scFv scFv-Fc Heavy Chain

SEQ ID NO: 3011 - protein, 107 aa, Artificial Sequence; identical to SEQ ID NO: 2871
  Description of Artificial Sequence: Synthetic polypeptide
  VH of XENP022851

SEQ ID NO: 3012 - protein, 122 aa, Artificial Sequence; identical to SEQ ID NO: 2872
  Description of Artificial Sequence: Synthetic polypeptide
  VL of XENP022851

SEQ ID NO: 3013 - protein, 231 aa, Artificial Sequence; identical to SEQ ID NO: 2409
  Description of Artificial Sequence: Synthetic polypeptide
  Fc chain of XENP022851

SEQ ID NO: 3014 - protein, 11 aa, Artificial Sequence
  Description of Artificial Sequence: Synthetic peptide
  XENP022851 vhCDR1
RASQSVGNDVA

SEQ ID NO: 3015 - protein, 7 aa, Artificial Sequence
  Description of Artificial Sequence: Synthetic peptide
  XENP022851 vhCDR2
YASHRYT

SEQ ID NO: 3016 - protein, 9 aa, Artificial Sequence
  Description of Artificial Sequence: Synthetic peptide
  XENP022851 vhCDR3
QQDFSSPRT

SEQ ID NO: 3017 - protein, 5 aa, Artificial Sequence
  Description of Artificial Sequence: Synthetic peptide
  XENP022851 vlCDR1
NYWMN

SEQ ID NO: 3018 - protein, 19 aa, Artificial Sequence
  Description of Artificial Sequence: Synthetic peptide
  XENP022851 vlCDR2
EIRLYSNNYATHYAESVKG

SEQ ID NO: 3019 - protein, 11 aa, Artificial Sequence
  Description of Artificial Sequence: Synthetic peptide
  XENP022851 vlCDR3
YYGNYGGYFDV

SEQ ID NO: 3020 - protein, 214 aa, Artificial Sequence; identical to SEQ ID NO: 2720
  Description of Artificial Sequence: Synthetic polypeptide
  XENP022851 2A11_H1.125_L2.126_Fab-1G6_L1.194_H1.279_scFv Light Chain

SEQ ID NO: 3021 - protein, 107 aa, Artificial Sequence; identical to SEQ ID NO: 2721
  Description of Artificial Sequence: Synthetic polypeptide
  VL of XENP022851

SEQ ID NO: 3022 - protein, 11 aa, Artificial Sequence
  Description of Artificial Sequence: Synthetic peptide
  XENP022851 vlCDR1
QASQDIGNYLN

SEQ ID NO: 3023 - protein, 7 aa, Artificial Sequence
  Description of Artificial Sequence: Synthetic peptide
  XENP022851 vlCDR2
FTSYLHS

SEQ ID NO: 3024 - protein, 9 aa, Artificial Sequence
  Description of Artificial Sequence: Synthetic peptide
  XENP022851 vlCDR3
QEGNTLPYT

SEQ ID NO: 3025 - protein, 447 aa, Artificial Sequence; identical to SEQ ID NO: 2685
  Description of Artificial Sequence: Synthetic polypeptide
  XENP022852 2A11_H1_L2.113_Fab-1G6_L1.194_H1.279_scFv Fab-Fc Heavy Chain

SEQ ID NO: 3026 - protein, 118 aa, Artificial Sequence; identical to SEQ ID NO: 2686
  Description of Artificial Sequence: Synthetic polypeptide
  VH of XENP022852

SEQ ID NO: 3027 - protein, 5 aa, Artificial Sequence
  Description of Artificial Sequence: Synthetic peptide
  XENP022852 vhCDR1
DYYMH

SEQ ID NO: 3028 - protein, 17 aa, Artificial Sequence
  Description of Artificial Sequence: Synthetic peptide
  XENP022852 vhCDR2
WIDPENGDTEYAPKFQG

SEQ ID NO: 3029 - protein, 9 aa, Artificial Sequence
  Description of Artificial Sequence: Synthetic peptide
  XENP022852 vhCDR3
RGVRQALDY

SEQ ID NO: 3030 - protein, 480 aa, Artificial Sequence; identical to SEQ ID NO: 2930
  Description of Artificial Sequence: Synthetic polypeptide
  XENP022852 2A11_H1_L2.113_Fab-1G6_L1.194_H1.279_scFv scFv-Fc Heavy Chain

SEQ ID NO: 3031 - protein, 107 aa, Artificial Sequence; identical to SEQ ID NO: 2871
  Description of Artificial Sequence: Synthetic polypeptide
  VH of XENP022852

SEQ ID NO: 3032 - protein, 122 aa, Artificial Sequence; identical to SEQ ID NO: 2872
  Description of Artificial Sequence: Synthetic polypeptide
  VL of XENP022852

SEQ ID NO: 3033 - protein, 231 aa, Artificial Sequence; identical to SEQ ID NO: 2409
  Description of Artificial Sequence: Synthetic polypeptide
  Fc chain of XENP022852

SEQ ID NO: 3034 - protein, 11 aa, Artificial Sequence
  Description of Artificial Sequence: Synthetic peptide
  XENP022852 vhCDR1
RASQSVGNDVA

SEQ ID NO: 3035 - protein, 7 aa, Artificial Sequence
  Description of Artificial Sequence: Synthetic peptide
  XENP022852 vhCDR2
YASHRYT

SEQ ID NO: 3036 - protein, 9 aa, Artificial Sequence
  Description of Artificial Sequence: Synthetic peptide
  XENP022852 vhCDR3
QQDFSSPRT

SEQ ID NO: 3037 - protein, 5 aa, Artificial Sequence
  Description of Artificial Sequence: Synthetic peptide
  XENP022852 vlCDR1
NYWMN

SEQ ID NO: 3038 - protein, 19 aa, Artificial Sequence
  Description of Artificial Sequence: Synthetic peptide
  XENP022852 vlCDR2
EIRLYSNNYATHYAESVKG

SEQ ID NO: 3039 - protein, 11 aa, Artificial Sequence
  Description of Artificial Sequence: Synthetic peptide
  XENP022852 vlCDR3
YYGNYGGYFDV

SEQ ID NO: 3040 - protein, 214 aa, Artificial Sequence; identical to SEQ ID NO: 2680
  Description of Artificial Sequence: Synthetic polypeptide
  XENP022852 2A11_H1_L2.113_Fab-1G6_L1.194_H1.279_scFv Light Chain

SEQ ID NO: 3041 - protein, 107 aa, Artificial Sequence; identical to SEQ ID NO: 2681
  Description of Artificial Sequence: Synthetic polypeptide
  VL of XENP022852

SEQ ID NO: 3042 - protein, 11 aa, Artificial Sequence
  Description of Artificial Sequence: Synthetic peptide
  XENP022852 vlCDR1
QASQDIGNYLN

SEQ ID NO: 3043 - protein, 7 aa, Artificial Sequence
  Description of Artificial Sequence: Synthetic peptide
  XENP022852 vlCDR2
FTSYLHS

SEQ ID NO: 3044 - protein, 9 aa, Artificial Sequence
  Description of Artificial Sequence: Synthetic peptide
  XENP022852 vlCDR3
QQGNTLPYT

SEQ ID NO: 3045 - protein, 447 aa, Artificial Sequence; identical to SEQ ID NO: 2885
  Description of Artificial Sequence: Synthetic polypeptide
  XENP023349 2A11_H1L2_Fab-1C11_H3L3_scFv Fab-Fc Heavy Chain

SEQ ID NO: 3046 - protein, 118 aa, Artificial Sequence; identical to SEQ ID NO: 2686
  Description of Artificial Sequence: Synthetic polypeptide
  VH of XENP023349

SEQ ID NO: 3047 - protein, 5 aa, Artificial Sequence
  Description of Artificial Sequence: Synthetic peptide
  XENP023349 vhCDR1
DYYMH

SEQ ID NO: 3048 - protein, 17 aa, Artificial Sequence
  Description of Artificial Sequence: Synthetic peptide
  XENP023349 vhCDR2
WIDPENGDTEYAPKFQG

SEQ ID NO: 3049 - protein, 9 aa, Artificial Sequence
  Description of Artificial Sequence: Synthetic peptide
  XENP023349 vhCDR3
RGVRQALDY

SEQ ID NO: 3050 - protein, 480 aa, Artificial Sequence
  Description of Artificial Sequence: Synthetic polypeptide
  XENP023349 2A11_H1L2_Fab-1C11_H3L3_scFv scFv-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3051 - protein, 117 aa, Artificial Sequence; identical to SEQ ID NO: 32
  Description of Artificial Sequence: Synthetic polypeptide
  VH of XENP023349

SEQ ID NO: 3052 - protein, 112 aa, Artificial Sequence; identical to SEQ ID NO: 7
  Description of Artificial Sequence: Synthetic polypeptide
  VL of XENP023349

SEQ ID NO: 3053 - protein, 231 aa, Artificial Sequence; identical to SEQ ID NO: 2397
  Description of Artificial Sequence: Synthetic polypeptide
  Fc chain of XENP023349

SEQ ID NO: 3054 - protein, 5 aa, Artificial Sequence
  Description of Artificial Sequence: Synthetic peptide
  XENP023349 vhCDR1
HYGMN

SEQ ID NO: 3055 - protein, 17 aa, Artificial Sequence
  Description of Artificial Sequence: Synthetic peptide
  XENP023349 vhCDR2
WINTYTGEPTYADGFTG

SEQ ID NO: 3056 - protein, 8 aa, Artificial Sequence
  Description of Artificial Sequence: Synthetic peptide
  XENP023349 vhCDR3
DYYGSSPY

SEQ ID NO: 3057 - protein, 16 aa, Artificial Sequence
  Description of Artificial Sequence: Synthetic peptide
  XENP023349 vlCDR1
KSSQSIVHSNGNTYLE

SEQ ID NO: 3058 - protein, 7 aa, Artificial Sequence
  Description of Artificial Sequence: Synthetic peptide
  XENP023349 vlCDR2
KVSNRFS

SEQ ID NO: 3059 - protein, 9 aa, Artificial Sequence
  Description of Artificial Sequence: Synthetic peptide
  XENP023349 vlCDR3
FQGSHVPNT

SEQ ID NO: 3060 - protein, 214 aa, Artificial Sequence; identical to SEQ ID NO: 2880
  Description of Artificial Sequence: Synthetic polypeptide
  XENP023349 2A11_H1L2_Fab-1C11_H3L3_scFv Light Chain

SEQ ID NO: 3061 - protein, 107 aa, Artificial Sequence; identical to SEQ ID NO: 2881
  Description of Artificial Sequence: Synthetic polypeptide
  VL of XENP023349

SEQ ID NO: 3062 - protein, 11 aa, Artificial Sequence
  Description of Artificial Sequence: Synthetic peptide
  XENP023349 vlCDR1
QASQDIGNYLN

SEQ ID NO: 3063 - protein, 7 aa, Artificial Sequence
  Description of Artificial Sequence: Synthetic peptide
  XENP023349 vlCDR2
YTSRLHS

SEQ ID NO: 3064 - protein, 9 aa, Artificial Sequence
  Description of Artificial Sequence: Synthetic peptide
  XENP023349 vlCDR3
QQGNTLPYT

SEQ ID NO: 3065 - protein, 447 aa, Artificial Sequence; identical to SEQ ID NO: 2865
  Description of Artificial Sequence: Synthetic polypeptide
  XENP023350 2A11_H1.144_L2.142_Fab-1C11_H3L3_scFv Fab-Fc Heavy Chain

SEQ ID NO: 3066 - protein, 118 aa, Artificial Sequence; identical to SEQ ID NO: 2646
  Description of Artificial Sequence: Synthetic polypeptide
  VH of XENP023350

SEQ ID NO: 3067 - protein, 5 aa, Artificial Sequence
  Description of Artificial Sequence: Synthetic peptide
  XENP023350 vhCDR1
DYFMH

SEQ ID NO: 3068 - protein, 17 aa, Artificial Sequence
  Description of Artificial Sequence: Synthetic peptide
  XENP023350 vhCDR2
WIDPELGDTEYAPKFQG

SEQ ID NO: 3069 - protein, 9 aa, Artificial Sequence
  Description of Artificial Sequence: Synthetic peptide
  XENP023350 vhCDR3
RGVYQALDY

SEQ ID NO: 3070 - protein, 480 aa, Artificial Sequence; identical to SEQ ID NO: 3050
  Description of Artificial Sequence: Synthetic polypeptide
  XENP023350 2A11_H1.144_L2.142_Fab-1C11_H3L3_scFv scFv-Fc Heavy Chain

SEQ ID NO: 3071 - protein, 117 aa, Artificial Sequence; identical to SEQ ID NO: 32
  Description of Artificial Sequence: Synthetic polypeptide
  VH of XENP023350

SEQ ID NO: 3072 - protein, 112 aa, Artificial Sequence; identical to SEQ ID NO: 7
  Description of Artificial Sequence: Synthetic polypeptide
  VL of XENP023350

SEQ ID NO: 3073 - protein, 231 aa, Artificial Sequence; identical to SEQ ID NO: 2397
  Description of Artificial Sequence: Synthetic polypeptide
  Fc chain of XENP023350

SEQ ID NO: 3074 - protein, 5 aa, Artificial Sequence
  Description of Artificial Sequence: Synthetic peptide
  XENP023350 vhCDR1
HYGMN

SEQ ID NO: 3075 - protein, 17 aa, Artificial Sequence
  Description of Artificial Sequence: Synthetic peptide
  XENP023350 vhCDR2
WINTYTGEPTYADGFTG

SEQ ID NO: 3076 - protein, 8 aa, Artificial Sequence
  Description of Artificial Sequence: Synthetic peptide
  XENP023350 vhCDR3
DYYGSSPY

SEQ ID NO: 3077 - protein, 16 aa, Artificial Sequence
  Description of Artificial Sequence: Synthetic peptide
  XENP023350 vlCDR1
KSSQSIVHSNGNTYLE

SEQ ID NO: 3078 - protein, 7 aa, Artificial Sequence
  Description of Artificial Sequence: Synthetic peptide
  XENP023350 vlCDR2
KVSNRFS

SEQ ID NO: 3079 - protein, 9 aa, Artificial Sequence
  Description of Artificial Sequence: Synthetic peptide
  XENP023350 vlCDR3
FQGSHVPNT

SEQ ID NO: 3080 - protein, 214 aa, Artificial Sequence; identical to SEQ ID NO: 2660
  Description of Artificial Sequence: Synthetic polypeptide
  XENP023350 2A11_H1.144_L2.142_Fab-1C11_H3L3_scFv Light Chain

SEQ ID NO: 3081 - protein, 107 aa, Artificial Sequence; identical to SEQ ID NO: 2661
  Description of Artificial Sequence: Synthetic polypeptide
  VL of XENP023350

SEQ ID NO: 3082 - protein, 11 aa, Artificial Sequence
  Description of Artificial Sequence: Synthetic peptide
  XENP023350 vlCDR1
QASQDIGNYLN

SEQ ID NO: 3083 - protein, 7 aa, Artificial Sequence
  Description of Artificial Sequence: Synthetic peptide
  XENP023350 vlCDR2
FTSYLHS

SEQ ID NO: 3084 - protein, 9 aa, Artificial Sequence
  Description of Artificial Sequence: Synthetic peptide
  XENP023350 vlCDR3
QQGNTLPYT

SEQ ID NO: 3085 - protein, 447 aa, Artificial Sequence; identical to SEQ ID NO: 2885
  Description of Artificial Sequence: Synthetic polypeptide
  XENP023351 2A11_H1L2_Fab-2E9_H1L1_scFv Fab-Fc Heavy Chain

SEQ ID NO: 3086 - protein, 118 aa, Artificial Sequence; identical to SEQ ID NO: 2686
  Description of Artificial Sequence: Synthetic polypeptide
  VH of XENP023351

SEQ ID NO: 3087 - protein, 5 aa, Artificial Sequence
  Description of Artificial Sequence: Synthetic peptide
  XENP023351 vhCDR1
DYYMH

SEQ ID NO: 3088 - protein, 17 aa, Artificial Sequence
  Description of Artificial Sequence: Synthetic peptide
  XENP023351 vhCDR2
WIDPENGDTEYAPKFQG

SEQ ID NO: 3089 - protein, 9 aa, Artificial Sequence
  Description of Artificial Sequence: Synthetic peptide
  XENP023351 vhCDR3
RGVRQALDY

SEQ ID NO: 3090 - protein, 478 aa, Artificial Sequence
  Description of Artificial Sequence: Synthetic polypeptide
  XENP023351 2A11_H1L2_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3091 - protein, 120 aa, Artificial Sequence
  Description of Artificial Sequence: Synthetic polypeptide
  VH of XENP023351
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS

SEQ ID NO: 3092 - protein, 107 aa, Artificial Sequence
  Description of Artificial Sequence: Synthetic polypeptide
  VL of XENP023351
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 3093 - protein, 231 aa, Artificial Sequence; identical to SEQ ID NO: 2397
  Description of Artificial Sequence: Synthetic polypeptide
  Fc chain of XENP023351

SEQ ID NO: 3094 - protein, 5 aa, Artificial Sequence
  Description of Artificial Sequence: Synthetic peptide
  XENP023351 vhCDR1
NYWLG

SEQ ID NO: 3095 - protein, 17 aa, Artificial Sequence
  Description of Artificial Sequence: Synthetic peptide
  XENP023351 vhCDR2
NFYPGSSNTYYNEKFQG

SEQ ID NO: 3096 - protein, 11 aa, Artificial Sequence
  Description of Artificial Sequence: Synthetic peptide
  XENP023351 vhCDR3
HYGTNYRYFDV

SEQ ID NO: 3097 - protein, 11 aa, Artificial Sequence
  Description of Artificial Sequence: Synthetic peptide
  XENP023351 vlCDR1
RASQSVSNDVA

SEQ ID NO: 3098 - protein, 7 aa, Artificial Sequence
  Description of Artificial Sequence: Synthetic peptide
  XENP023351 vlCDR2
YASNRYT

SEQ ID NO: 3099 - protein, 9 aa, Artificial Sequence
  Description of Artificial Sequence: Synthetic peptide
  XENP023351 vlCDR3
QQDYSSPYT

SEQ ID NO: 3100 - protein, 214 aa, Artificial Sequence; identical to SEQ ID NO: 2880
  Description of Artificial Sequence: Synthetic polypeptide
  XENP023351 2A11_H1L2_Fab-2E9_H1L1_scFv Light Chain

SEQ ID NO: 3101 - protein, 107 aa, Artificial Sequence; identical to SEQ ID NO: 2881
  Description of Artificial Sequence: Synthetic polypeptide
  VL of XENP023351

SEQ ID NO: 3102 - protein, 11 aa, Artificial Sequence
  Description of Artificial Sequence: Synthetic peptide
  XENP023351 vlCDR1
QASQDIGNYLN

SEQ ID NO: 3103 - protein, 7 aa, Artificial Sequence
  Description of Artificial Sequence: Synthetic peptide
  XENP023351 vlCDR2
YTSRLHS

SEQ ID NO: 3104 - protein, 9 aa, Artificial Sequence
  Description of Artificial Sequence: Synthetic peptide
  XENP023351 vlCDR3
QQGNTLPYT

SEQ ID NO: 3105 - protein, 447 aa, Artificial Sequence; identical to SEQ ID NO: 2865
  Description of Artificial Sequence: Synthetic polypeptide
  XENP023352 2A11_H1.144_L2.142_Fab-2E9_H1L1_scFv Fab-Fc Heavy Chain

SEQ ID NO: 3106 - protein, 118 aa, Artificial Sequence; identical to SEQ ID NO: 2646
  Description of Artificial Sequence: Synthetic polypeptide
  VH of XENP023352

SEQ ID NO: 3107 - protein, 5 aa, Artificial Sequence
  Description of Artificial Sequence: Synthetic peptide
  XENP023352 vhCDR1
DYFMH

SEQ ID NO: 3108 - protein, 17 aa, Artificial Sequence
  Description of Artificial Sequence: Synthetic peptide
  XENP023352 vhCDR2
WIDPELGDTEYAPKFQG

SEQ ID NO: 3109 - protein, 9 aa, Artificial Sequence
  Description of Artificial Sequence: Synthetic peptide
  XENP023352 vhCDR3
RGVYQALDY

SEQ ID NO: 3110 - protein, 458 aa, Artificial Sequence
  Description of Artificial Sequence: Synthetic polypeptide
  XENP023352 2A11_H1.144_L2.142_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3111 - protein, 120 aa, Artificial Sequence; identical to SEQ ID NO: 3091
  Description of Artificial Sequence: Synthetic polypeptide
  VH of XENP023352

SEQ ID NO: 3112 - protein, 107 aa, Artificial Sequence; identical to SEQ ID NO: 3092
  Description of Artificial Sequence: Synthetic polypeptide
  VL of XENP023352

SEQ ID NO: 3113 - protein, 231 aa, Artificial Sequence; identical to SEQ ID NO: 2397
  Description of Artificial Sequence: Synthetic polypeptide
  Fc chain of XENP023352

SEQ ID NO: 3114 - protein, 5 aa, Artificial Sequence
  Description of Artificial Sequence: Synthetic peptide
  XENP023352 vhCDR1
NYWLG

SEQ ID NO: 3115 - protein, 17 aa, Artificial Sequence
  Description of Artificial Sequence: Synthetic peptide
  XENP023352 vhCDR2
NFYPGSSNTYYNEKFQG

SEQ ID NO: 3116 - protein, 11 aa, Artificial Sequence
  Description of Artificial Sequence: Synthetic peptide
  XENP023352 vhCDR3
HYGTNYRYFDV

SEQ ID NO: 3117 - protein, 11 aa, Artificial Sequence
  Description of Artificial Sequence: Synthetic peptide
  XENP023352 vlCDR1
RASQSVSNDVA

SEQ ID NO: 3118 - protein, 7 aa, Artificial Sequence
  Description of Artificial Sequence: Synthetic peptide
  XENP023352 vlCDR2
YASNRYT

SEQ ID NO: 3119 - protein, 9 aa, Artificial Sequence
  Description of Artificial Sequence: Synthetic peptide
  XENP023352 vlCDR3
QQDYSSPYT

SEQ ID NO: 3120 - protein, 214 aa, Artificial Sequence; identical to SEQ ID NO: 2660
  Description of Artificial Sequence: Synthetic polypeptide
  XENP023352 2A11_H1.144_L2.142_Fab-2E9_H1L1_scFv Light Chain

SEQ ID NO: 3121 - protein, 107 aa, Artificial Sequence; identical to SEQ ID NO: 2661
  Description of Artificial Sequence: Synthetic polypeptide
  VL of XENP023352

SEQ ID NO: 3122 - protein, 11 aa, Artificial Sequence
  Description of Artificial Sequence: Synthetic peptide
  XENP023352 vlCDR1
QASQDIGNYLN

SEQ ID NO: 3123 - protein, 7 aa, Artificial Sequence
  Description of Artificial Sequence: Synthetic peptide
  XENP023352 vlCDR2
FTSYLHS

SEQ ID NO: 3124 - protein, 9 aa, Artificial Sequence
  Description of Artificial Sequence: Synthetic peptide
  XENP023352 vlCDR3
QQGNTLPYT

SEQ ID NO: 3125 - protein, 446 aa, Artificial Sequence
  Description of Artificial Sequence: Synthetic polypeptide
  XENP022856 1C11_H3L3_IgG1_PVA_/S267K/M428L/N434S Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 3126 - protein, 117 aa, Artificial Sequence; identical to SEQ ID NO: 32
  Description of Artificial Sequence: Synthetic polypeptide
  VH of XENP022856

SEQ ID NO: 3127 - protein, 5 aa, Artificial Sequence
  Description of Artificial Sequence: Synthetic peptide
  XENP022856 vhCDR1
HYGMN

SEQ ID NO: 3128 - protein, 17 aa, Artificial Sequence
  Description of Artificial Sequence: Synthetic peptide
  XENP022856 vhCDR2
WINTYTGEPTYADGFTG

SEQ ID NO: 3129 - protein, 8 aa, Artificial Sequence
  Description of Artificial Sequence: Synthetic peptide
  XENP022856 vhCDR3
DYYGSSPY

SEQ ID NO: 3130 - protein, 219 aa, Artificial Sequence; identical to SEQ ID NO: 6
  Description of Artificial Sequence: Synthetic polypeptide
  XENP022856 1C11_H3L3_IgG1_PVA_/S267K/M428L/N434S Light Chain

SEQ ID NO: 3131 - protein, 112 aa, Artificial Sequence; identical to SEQ ID NO: 7
  Description of Artificial Sequence: Synthetic polypeptide
  VL of XENP022856

SEQ ID NO: 3132 - protein, 16 aa, Artificial Sequence
  Description of Artificial Sequence: Synthetic peptide
  XENP022856 vlCDR1
KSSQSIVHSNGNTYLE

SEQ ID NO: 3133 - protein, 7 aa, Artificial Sequence
  Description of Artificial Sequence: Synthetic peptide
  XENP022856 vlCDR2
KVSNRFS

SEQ ID NO: 3134 - protein, 9 aa, Artificial Sequence
  Description of Artificial Sequence: Synthetic peptide
  XENP022856 vlCDR3
FQGSHVPNT

SEQ ID NO: 3135 - protein, 449 aa, Artificial Sequence
  Description of Artificial Sequence: Synthetic polypeptide
  XENP022857 2E9_H1L1_IgG1_PVA_/S267K/M428L/N434S Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 3136 - protein, 120 aa, Artificial Sequence; identical to SEQ ID NO: 3091
  Description of Artificial Sequence: Synthetic polypeptide
  VH of XENP022857

SEQ ID NO: 3137 - protein, 5 aa, Artificial Sequence
  Description of Artificial Sequence: Synthetic peptide
  XENP022857 vhCDR1
NYWLG

SEQ ID NO: 3138 - protein, 17 aa, Artificial Sequence
  Description of Artificial Sequence: Synthetic peptide
  XENP022857 vhCDR2
NFYPGSSNTYYNEKFQG

SEQ ID NO: 3139 - protein, 11 aa, Artificial Sequence
  Description of Artificial Sequence: Synthetic peptide
  XENP022857 vhCDR3
HYGTNYRYFDV

SEQ ID NO: 3140 - protein, 214 aa, Artificial Sequence
  Description of Artificial Sequence: Synthetic polypeptide
  XENP022857 2E9_H1L1_IgG1_PVA_/S267K/M428L/N434S Light Chain
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3141 - protein, 107 aa, Artificial Sequence; identical to SEQ ID NO: 3092
  Description of Artificial Sequence: Synthetic polypeptide
  VL of XENP022857

SEQ ID NO: 3142 - protein, 11 aa, Artificial Sequence
  Description of Artificial Sequence: Synthetic peptide
  XENP022857 vlCDR1
RASQSVSNDVA

SEQ ID NO: 3143 - protein, 7 aa, Artificial Sequence
  Description of Artificial Sequence: Synthetic peptide
  XENP022857 vlCDR2
YASNRYT

SEQ ID NO: 3144 - protein, 9 aa, Artificial Sequence
  Description of Artificial Sequence: Synthetic peptide
  XENP022857 vlCDR3
QQDYSSPYT

SEQ ID NO: 3145 - protein, 447 aa, Artificial Sequence
  Description of Artificial Sequence: Synthetic polypeptide
  XENP022858 9C6_H1.1_L1_Fab-1G6_L1.194_H1.279_scFv Fab-Fc Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 3146 - protein, 118 aa, Artificial Sequence
  Description of Artificial Sequence: Synthetic polypeptide
  VH of XENP022858
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 3147 - protein, 5 aa, Artificial Sequence
  Description of Artificial Sequence: Synthetic peptide
  XENP022858 vhCDR1
GYGVN

SEQ ID NO: 3148 - protein, 16 aa, Artificial Sequence
  Description of Artificial Sequence: Synthetic peptide
  XENP022858 vhCDR2
MIWIDGSTDYNSKFQG

SEQ ID NO: 3149 - protein, 10 aa, Artificial Sequence
  Description of Artificial Sequence: Synthetic peptide
  XENP022858 vhCDR3
DRPDGRAMDY

SEQ ID NO: 3150 - protein, 480 aa, Artificial Sequence; identical to SEQ ID NO: 2930
  Description of Artificial Sequence: Synthetic polypeptide
  XENP022858 9C6_H1.1_L1_Fab-1G6_L1.194_H1.279_scFv scFv-Fc Heavy Chain

SEQ ID NO: 3151 - protein, 107 aa, Artificial Sequence; identical to SEQ ID NO: 2871
  Description of Artificial Sequence: Synthetic polypeptide
  VH of XENP022858

SEQ ID NO: 3152 - protein, 122 aa, Artificial Sequence; identical to SEQ ID NO: 2872
  Description of Artificial Sequence: Synthetic polypeptide
  VL of XENP022858

SEQ ID NO: 3153 - protein, 231 aa, Artificial Sequence; identical to SEQ ID NO: 2409
  Description of Artificial Sequence: Synthetic polypeptide
  Fc chain of XENP022858

SEQ ID NO: 3154 - protein, 11 aa, Artificial Sequence
  Description of Artificial Sequence: Synthetic peptide
  XENP022858 vhCDR1
RASQSVGNDVA

SEQ ID NO: 3155 - protein, 7 aa, Artificial Sequence
  Description of Artificial Sequence: Synthetic peptide
  XENP022858 vhCDR2
YASHRYT

SEQ ID NO: 3156 - protein, 9 aa, Artificial Sequence
  Description of Artificial Sequence: Synthetic peptide
  XENP022858 vhCDR3
QQDFSSPRT

SEQ ID NO: 3157 - protein, 5 aa, Artificial Sequence
  Description of Artificial Sequence: Synthetic peptide
  XENP022858 vlCDR1
NYWMN

SEQ ID NO: 3158 - protein, 19 aa, Artificial Sequence
  Description of Artificial Sequence: Synthetic peptide
  XENP022858 vlCDR2
EIRLYSNNYATHYAESVKG

SEQ ID NO: 3159 - protein, 11 aa, Artificial Sequence
  Description of Artificial Sequence: Synthetic peptide
  XENP022858 vlCDR3
YYGNYGGYFDV

SEQ ID NO: 3160 - protein, 213 aa, Artificial Sequence
  Description of Artificial Sequence: Synthetic polypeptide
  XENP022858 9C6_H1.1_L1_Fab-1G6_L1.194_H1.279_scFv Light Chain
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3161 - protein, 106 aa, Artificial Sequence
  Description of Artificial Sequence: Synthetic polypeptide
  VL of XENP022858
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 3162 - protein, 11 aa, Artificial Sequence
  Description of Artificial Sequence: Synthetic peptide
  XENP022858 vlCDR1
KASQSVSNDVA

SEQ ID NO: 3163 - protein, 7 aa, Artificial Sequence
  Description of Artificial Sequence: Synthetic peptide
  XENP022858 vlCDR2
YASNRYT

SEQ ID NO: 3164 - protein, 8 aa, Artificial Sequence
  Description of Artificial Sequence: Synthetic peptide
  XENP022858 vlCDR3
QQDYSSPT

SEQ ID NO: 3165 - protein, 446 aa, Artificial Sequence
  Description of Artificial Sequence: Synthetic polypeptide
  XENP022726 1C11_H1L3_Fab-[CTLA-4]_H3.23_L0.129_scFv Fab-Fc Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 3166 - protein, 117 aa, Artificial Sequence; identical to SEQ ID NO: 2
  Description of Artificial Sequence: Synthetic polypeptide
  VH of XENP022726

SEQ ID NO: 3167 - protein, 5 aa, Artificial Sequence
  Description of Artificial Sequence: Synthetic peptide
  XENP022726 vhCDR1
HYGMN

SEQ ID NO: 3168 - protein, 17 aa, Artificial Sequence
  Description of Artificial Sequence: Synthetic peptide
  XENP022726 vhCDR2
WINTYTGEPTYADKFQG

SEQ ID NO: 3169 - protein, 8 aa, Artificial Sequence
  Description of Artificial Sequence: Synthetic peptide
  XENP022726 vhCDR3
DYYGSSPY

SEQ ID NO: 3170 - protein, 477 aa, Artificial Sequence; identical to SEQ ID NO: 2394
  Description of Artificial Sequence: Synthetic polypeptide
  XENP022726 1C11_H1L3_Fab-[CTLA-4]_H3.23_L0.129_scFv scFv-Fc Heavy Chain

SEQ ID NO: 3171 - protein, 118 aa, Artificial Sequence; identical to SEQ ID NO: 2395
  Description of Artificial Sequence: Synthetic polypeptide
  VH of XENP022726

SEQ ID NO: 3172 - protein, 108 aa, Artificial Sequence; identical to SEQ ID NO: 2396
  Description of Artificial Sequence: Synthetic polypeptide
  VL of XENP022726

SEQ ID NO: 3173 - protein, 231 aa, Artificial Sequence; identical to SEQ ID NO: 2397
  Description of Artificial Sequence: Synthetic polypeptide
  Fc chain of XENP022726

SEQ ID NO: 3174 - protein, 5 aa, Artificial Sequence
  Description of Artificial Sequence: Synthetic peptide
  XENP022726 vhCDR1
SYTMH

SEQ ID NO: 3175 - protein, 17 aa, Artificial Sequence
  Description of Artificial Sequence: Synthetic peptide
  XENP022726 vhCDR2
FISYDGNYKYYADSVKG

SEQ ID NO: 3176 - protein, 9 aa, Artificial Sequence
  Description of Artificial Sequence: Synthetic peptide
  XENP022726 vhCDR3
GGHLGPFDL

SEQ ID NO: 3177 - protein, 12 aa, Artificial Sequence
  Description of Artificial Sequence: Synthetic peptide
  XENP022726 vlCDR1
RASQSVGSSYLA

SEQ ID NO: 3178 - protein, 7 aa, Artificial Sequence
  Description of Artificial Sequence: Synthetic peptide
  XENP022726 vlCDR2
GASSRAT

SEQ ID NO: 3179 - protein, 9 aa, Artificial Sequence
  Description of Artificial Sequence: Synthetic peptide
  XENP022726 vlCDR3
QQYGSSPWT

SEQ ID NO: 3180 - protein, 219 aa, Artificial Sequence; identical to SEQ ID NO: 6
  Description of Artificial Sequence: Synthetic polypeptide
  XENP022726 1C11_H1L3_Fab-[CTLA-4]_H3.23_L0.129_scFv Light Chain

SEQ ID NO: 3181 - protein, 112 aa, Artificial Sequence; identical to SEQ ID NO: 7
  Description of Artificial Sequence: Synthetic polypeptide
  VL of XENP022726

SEQ ID NO: 3182 - protein, 16 aa, Artificial Sequence
  Description of Artificial Sequence: Synthetic peptide
  XENP022726 vlCDR1
KSSQSIVHSNGNTYLE

SEQ ID NO: 3183 - protein, 7 aa, Artificial Sequence
  Description of Artificial Sequence: Synthetic peptide
  XENP022726 vlCDR2
KVSNRFS

SEQ ID NO: 3184 - protein, 9 aa, Artificial Sequence
  Description of Artificial Sequence: Synthetic peptide
  XENP022726 vlCDR3
FQGSHVPNT

SEQ ID NO: 3185 - protein, 446 aa, Artificial Sequence
  Description of Artificial Sequence: Synthetic polypeptide
  XENP022727 1C11_H2L1_Fab-[CTLA-4]_H3.23_L0.129_scFv Fab-Fc Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 3186 - protein, 117 aa, Artificial Sequence; identical to SEQ ID NO: 12
  Description of Artificial Sequence: Synthetic polypeptide
  VH of XENP022727

SEQ ID NO: 3187 - protein, 5 aa, Artificial Sequence
  Description of Artificial Sequence: Synthetic peptide
  XENP022727 vhCDR1
HYGMN

SEQ ID NO: 3188 - protein, 17 aa, Artificial Sequence
  Description of Artificial Sequence: Synthetic peptide
  XENP022727 vhCDR2
WINTYTGEPTYADSVKG

SEQ ID NO: 3189 - protein, 8 aa, Artificial Sequence
  Description of Artificial Sequence: Synthetic peptide
  XENP022727 vhCDR3
DYYGSSPY

SEQ ID NO: 3190 - protein, 477 aa, Artificial Sequence; identical to SEQ ID NO: 2394
  Description of Artificial Sequence: Synthetic polypeptide
  XENP022727 1C11_H2L1_Fab-[CTLA-4]_H3.23_L0.129_scFv scFv-Fc Heavy Chain

SEQ ID NO: 3191 - protein, 118 aa, Artificial Sequence; identical to SEQ ID NO: 2395
  Description of Artificial Sequence: Synthetic polypeptide
  VH of XENP022727

SEQ ID NO: 3192 - protein, 108 aa, Artificial Sequence; identical to SEQ ID NO: 2396
  Description of Artificial Sequence: Synthetic polypeptide
  VL of XENP022727

SEQ ID NO: 3193 - protein, 231 aa, Artificial Sequence; identical to SEQ ID NO: 2397
  Description of Artificial Sequence: Synthetic polypeptide
  Fc chain of XENP022727

SEQ ID NO: 3194 - protein, 5 aa, Artificial Sequence
  Description of Artificial Sequence: Synthetic peptide
  XENP022727 vhCDR1
SYTMH

SEQ ID NO: 3195 - protein, 17 aa, Artificial Sequence
  Description of Artificial Sequence: Synthetic peptide
  XENP022727 vhCDR2
FISYDGNYKYYADSVKG

SEQ ID NO: 3196 - protein, 9 aa, Artificial Sequence
  Description of Artificial Sequence: Synthetic peptide
  XENP022727 vhCDR3
GGHLGPFDL

SEQ ID NO: 3197 - protein, 12 aa, Artificial Sequence
  Description of Artificial Sequence: Synthetic peptide
  XENP022727 vlCDR1
RASQSVGSSYLA

SEQ ID NO: 3198 - protein, 7 aa, Artificial Sequence
  Description of Artificial Sequence: Synthetic peptide
  XENP022727 vlCDR2
GASSRAT

SEQ ID NO: 3199 - protein, 9 aa, Artificial Sequence
  Description of Artificial Sequence: Synthetic peptide
  XENP022727 vlCDR3
QQYGSSPWT

SEQ ID NO: 3200 - protein, 219 aa, Artificial Sequence; identical to SEQ ID NO: 16
  Description of Artificial Sequence: Synthetic polypeptide
  XENP022727 1C11_H2L1_Fab-[CTLA-4]_H3.23_L0.129_scFv Light Chain

SEQ ID NO: 3201 - protein, 112 aa, Artificial Sequence; identical to SEQ ID NO: 17
  Description of Artificial Sequence: Synthetic polypeptide
  VL of XENP022727

SEQ ID NO: 3202 - protein, 16 aa, Artificial Sequence
  Description of Artificial Sequence: Synthetic peptide
  XENP022727 vlCDR1
RSSQSIVHSNGNTYLE

SEQ ID NO: 3203 - protein, 7 aa, Artificial Sequence
  Description of Artificial Sequence: Synthetic peptide
  XENP022727 vlCDR2
KVSNRFS

SEQ ID NO: 3204 - protein, 9 aa, Artificial Sequence
  Description of Artificial Sequence: Synthetic peptide
  XENP022727 vlCDR3
FQGSHVPNT

SEQ ID NO: 3205 - protein, 446 aa, Artificial Sequence; identical to SEQ ID NO: 3185
  Description of Artificial Sequence: Synthetic polypeptide
  XENP022728 1C11_H2L2_Fab-[CTLA-4]_H3.23_L0.129_scFv Fab-Fc Heavy Chain

SEQ ID NO: 3206 - protein, 117 aa, Artificial Sequence; identical to SEQ ID NO: 12
  Description of Artificial Sequence: Synthetic polypeptide
  VH of XENP022728

SEQ ID NO: 3207 - protein, 5 aa, Artificial Sequence
  Description of Artificial Sequence: Synthetic peptide
  XENP022728 vhCDR1
HYGMN

SEQ ID NO: 3208 - protein, 17 aa, Artificial Sequence
  Description of Artificial Sequence: Synthetic peptide
  XENP022728 vhCDR2
WINTYTGEPTYADSVKG

SEQ ID NO: 3209 - protein, 8 aa, Artificial Sequence
  Description of Artificial Sequence: Synthetic peptide
  XENP022728 vhCDR3
DYYGSSPY

SEQ ID NO: 3210 - protein, 477 aa, Artificial Sequence; identical to SEQ ID NO: 2394
  Description of Artificial Sequence: Synthetic polypeptide
  XENP022728 1C11_H2L2_Fab-[CTLA-4]_H3.23_L0.129_scFv scFv-Fc Heavy Chain

SEQ ID NO: 3211 - protein, 118 aa, Artificial Sequence; identical to SEQ ID NO: 2395
  Description of Artificial Sequence: Synthetic polypeptide
  VH of XENP022728

SEQ ID NO: 3212 - protein, 108 aa, Artificial Sequence; identical to SEQ ID NO: 2396
  Description of Artificial Sequence: Synthetic polypeptide
  VL of XENP022728

SEQ ID NO: 3213 - protein, 231 aa, Artificial Sequence; identical to SEQ ID NO: 2397
  Description of Artificial Sequence: Synthetic polypeptide
  Fc chain of XENP022728

SEQ ID NO: 3214 - protein, 5 aa, Artificial Sequence
  Description of Artificial Sequence: Synthetic peptide
  XENP022728 vhCDR1
SYTMH

SEQ ID NO: 3215 - protein, 17 aa, Artificial Sequence
  Description of Artificial Sequence: Synthetic peptide
  XENP022728 vhCDR2
FISYDGNYKYYADSVKG

SEQ ID NO: 3216 - protein, 9 aa, Artificial Sequence
  Description of Artificial Sequence: Synthetic peptide
  XENP022728 vhCDR3
GGHLGPFDL

SEQ ID NO: 3217 - protein, 12 aa, Artificial Sequence
  Description of Artificial Sequence: Synthetic peptide
  XENP022728 vlCDR1
RASQSVGSSYLA

SEQ ID NO: 3218 - protein, 7 aa, Artificial Sequence
  Description of Artificial Sequence: Synthetic peptide
  XENP022728 vlCDR2
GASSRAT

SEQ ID NO: 3219 - protein, 9 aa, Artificial Sequence
  Description of Artificial Sequence: Synthetic peptide
  XENP022728 vlCDR3
QQYGSSPWT

SEQ ID NO: 3220 - protein, 219 aa, Artificial Sequence; identical to SEQ ID NO: 26
  Description of Artificial Sequence: Synthetic polypeptide
  XENP022728 1C11_H2L2_Fab-[CTLA-4]_H3.23_L0.129_scFv Light Chain

SEQ ID NO: 3221 - protein, 112 aa, Artificial Sequence; identical to SEQ ID NO: 27
  Description of Artificial Sequence: Synthetic polypeptide
  VL of XENP022728

SEQ ID NO: 3222 - protein, 16 aa, Artificial Sequence
  Description of Artificial Sequence: Synthetic peptide
  XENP022728 vlCDR1
RSSQSIVHSNGNTYLE

SEQ ID NO: 3223 - protein, 7 aa, Artificial Sequence
  Description of Artificial Sequence: Synthetic peptide
  XENP022728 vlCDR2
KVSNRFS

SEQ ID NO: 3224 - protein, 9 aa, Artificial Sequence
  Description of Artificial Sequence: Synthetic peptide
  XENP022728 vlCDR3
FQGSHVPNT

SEQ ID NO: 3225 - protein, 446 aa, Artificial Sequence
  Description of Artificial Sequence: Synthetic polypeptide
  XENP022729 1C11_H3L3_Fab-[CTLA-4]_H3.23_L0.129_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 3226 - protein, 117 aa, Artificial Sequence; identical to SEQ ID NO: 32
  Description of Artificial Sequence: Synthetic polypeptide
  VH of XENP022729

SEQ ID NO: 3227 - protein, 5 aa, Artificial Sequence
  Description of Artificial Sequence: Synthetic peptide
  XENP022729 vhCDR1
HYGMN

SEQ ID NO: 3228 - protein, 17 aa, Artificial Sequence
  Description of Artificial Sequence: Synthetic peptide
  XENP022729 vhCDR2
WINTYTGEPTYADGFTG

SEQ ID NO: 3229 - protein, 8 aa, Artificial Sequence
  Description of Artificial Sequence: Synthetic peptide
  XENP022729 vhCDR3
DYYGSSPY

SEQ ID NO: 3230 - protein, 477 aa, Artificial Sequence; identical to SEQ ID NO: 2394
  Description of Artificial Sequence: Synthetic polypeptide
  XENP022729 1C11_H3L3_Fab-[CTLA-4]_H3.23_L0.129_scFv scFv-Fc Heavy Chain

SEQ ID NO: 3231 - protein, 118 aa, Artificial Sequence; identical to SEQ ID NO: 2395
  Description of Artificial Sequence: Synthetic polypeptide
  VH of XENP022729

SEQ ID NO: 3232 - protein, 108 aa, Artificial Sequence; identical to SEQ ID NO: 2396
  Description of Artificial Sequence: Synthetic polypeptide
  VL of XENP022729

SEQ ID NO: 3233 - protein, 231 aa, Artificial Sequence; identical to SEQ ID NO: 2397
  Description of Artificial Sequence: Synthetic polypeptide
  Fc chain of XENP022729

SEQ ID NO: 3234 - protein, 5 aa, Artificial Sequence
  Description of Artificial Sequence: Synthetic peptide
  XENP022729 vhCDR1
SYTMH

SEQ ID NO: 3235 - protein, 17 aa, Artificial Sequence
  Description of Artificial Sequence: Synthetic peptide
  XENP022729 vhCDR2
FISYDGNYKYYADSVKG

SEQ ID NO: 3236 - protein, 9 aa, Artificial Sequence
  Description of Artificial Sequence: Synthetic peptide
  XENP022729 vhCDR3
GGHLGPFDL

SEQ ID NO: 3237 - protein, 12 aa, Artificial Sequence
  Description of Artificial Sequence: Synthetic peptide
  XENP022729 vlCDR1
RASQSVGSSYLA

SEQ ID NO: 3238 - protein, 7 aa, Artificial Sequence
  Description of Artificial Sequence: Synthetic peptide
  XENP022729 vlCDR2
GASSRAT

SEQ ID NO: 3239 - protein, 9 aa, Artificial Sequence
  Description of Artificial Sequence: Synthetic peptide
  XENP022729 vlCDR3
QQYGSSPWT

SEQ ID NO: 3240 - protein, 219 aa, Artificial Sequence; identical to SEQ ID NO: 6
  Description of Artificial Sequence: Synthetic polypeptide
  XENP022729 1C11_H3L3_Fab-[CTLA-4]_H3.23_L0.129_scFv Light Chain

SEQ ID NO: 3241 - protein, 112 aa, Artificial Sequence; identical to SEQ ID NO: 7
  Description of Artificial Sequence: Synthetic polypeptide
  VL of XENP022729

SEQ ID NO: 3242 - protein, 16 aa, Artificial Sequence
  Description of Artificial Sequence: Synthetic peptide
  XENP022729 vlCDR1
KSSQSIVHSNGNTYLE

SEQ ID NO: 3243 - protein, 7 aa, Artificial Sequence
  Description of Artificial Sequence: Synthetic peptide
  XENP022729 vlCDR2
KVSNRFS

SEQ ID NO: 3244 - protein, 9 aa, Artificial Sequence
  Description of Artificial Sequence: Synthetic peptide
  XENP022729 vlCDR3
FQGSHVPNT

SEQ ID NO: 3245 - protein, 449 aa, Artificial Sequence
  Description of Artificial Sequence: Synthetic polypeptide
  XENP022836 2E9_H1L1_Fab-[CTLA-4]_H3.23_L0.129_scFv HC-Fab
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 3246 - protein, 120 aa, Artificial Sequence; identical to SEQ ID NO: 3091
  Description of Artificial Sequence: Synthetic polypeptide
  VH of XENP022836

SEQ ID NO: 3247 - protein, 5 aa, Artificial Sequence
  Description of Artificial Sequence: Synthetic peptide
  XENP022836 vhCDR1
NYWLG

SEQ ID NO: 3248 - protein, 17 aa, Artificial Sequence
  Description of Artificial Sequence: Synthetic peptide
  XENP022836 vhCDR2
NFYPGSSNTYYNEKFQG

SEQ ID NO: 3249 - protein, 11 aa, Artificial Sequence
  Description of Artificial Sequence: Synthetic peptide
  XENP022836 vhCDR3
HYGTNYRYFDV

SEQ ID NO: 3250 - protein, 477 aa, Artificial Sequence; identical to SEQ ID NO: 2394
  Description of Artificial Sequence: Synthetic polypeptide
  XENP022836 2E9_H1L1_Fab-[CTLA-4]_H3.23_L0.129_scFv HC-scFV

SEQ ID NO: 3251 - protein, 118 aa, Artificial Sequence; identical to SEQ ID NO: 2395
  Description of Artificial Sequence: Synthetic polypeptide
  VH of XENP022836

SEQ ID NO: 3252 - protein, 108 aa, Artificial Sequence; identical to SEQ ID NO: 2396
  Description of Artificial Sequence: Synthetic polypeptide
  VL of XENP022836

SEQ ID NO: 3253 - protein, 231 aa, Artificial Sequence; identical to SEQ ID NO: 2397
  Description of Artificial Sequence: Synthetic polypeptide
  Fc chain of XENP022836

SEQ ID NO: 3254 - protein, 5 aa, Artificial Sequence
  Description of Artificial Sequence: Synthetic peptide
  XENP022836 vhCDR1
SYTMH

SEQ ID NO: 3255 - protein, 17 aa, Artificial Sequence
  Description of Artificial Sequence: Synthetic peptide
  XENP022836 vhCDR2
FISYDGNYKYYADSVKG

SEQ ID NO: 3256 - protein, 9 aa, Artificial Sequence
  Description of Artificial Sequence: Synthetic peptide
  XENP022836 vhCDR3
GGHLGPFDL

SEQ ID NO: 3257 - protein, 12 aa, Artificial Sequence
  Description of Artificial Sequence: Synthetic peptide
  XENP022836 vlCDR1
RASQSVGSSYLA

SEQ ID NO: 3258 - protein, 7 aa, Artificial Sequence
  Description of Artificial Sequence: Synthetic peptide
  XENP022836 vlCDR2
GASSRAT

SEQ ID NO: 3259 - protein, 9 aa, Artificial Sequence
  Description of Artificial Sequence: Synthetic peptide
  XENP022836 vlCDR3
QQYGSSPWT

SEQ ID NO: 3260 - protein, 214 aa, Artificial Sequence; identical to SEQ ID NO: 3140
  Description of Artificial Sequence: Synthetic polypeptide
  XENP022836 2E9_H1L1_Fab-[CTLA-4]_H3.23_L0.129_scFv Light Chain

SEQ ID NO: 3261 - protein, 107 aa, Artificial Sequence; identical to SEQ ID NO: 3092
  Description of Artificial Sequence: Synthetic polypeptide
  VL of XENP022836

SEQ ID NO: 3262 - protein, 11 aa, Artificial Sequence
  Description of Artificial Sequence: Synthetic peptide
  XENP022836 vlCDR1
RASQSVSNDVA

SEQ ID NO: 3263 - protein, 7 aa, Artificial Sequence
  Description of Artificial Sequence: Synthetic peptide
  XENP022836 vlCDR2
YASNRYT

SEQ ID NO: 3264 - protein, 9 aa, Artificial Sequence
  Description of Artificial Sequence: Synthetic peptide
  XENP022836 vlCDR3
QQDYSSPYT

SEQ ID NO: 3265 - protein, 446 aa, Artificial Sequence
  Description of Artificial Sequence: Synthetic polypeptide
  XENP022854 1C11_H3L3_Fab-[CTLA-4]_H3.23_L0.129_[CTLA-4]_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 3266 - protein, 117 aa, Artificial Sequence; identical to SEQ ID NO: 32
  Description of Artificial Sequence: Synthetic polypeptide
  VH of XENP022854

SEQ ID NO: 3267 - protein, 5 aa, Artificial Sequence
  Description of Artificial Sequence: Synthetic peptide
  XENP022854 vhCDR1
HYGMN

SEQ ID NO: 3268 - protein, 17 aa, Artificial Sequence
  Description of Artificial Sequence: Synthetic peptide
  XENP022854 vhCDR2
WINTYTGEPTYADGFTG

SEQ ID NO: 3269 - protein, 8 aa, Artificial Sequence
  Description of Artificial Sequence: Synthetic peptide
  XENP022854 vhCDR3
DYYGSSPY

SEQ ID NO: 3270 - protein, 477 aa, Artificial Sequence; identical to SEQ ID NO: 2610
  Description of Artificial Sequence: Synthetic polypeptide
  XENP022854 1C11_H3L3_Fab-[CTLA-4]_H3.23_L0.129_[CTLA-4]_scFv scFv-Fc Heavy Chain

SEQ ID NO: 3271 - protein, 118 aa, Artificial Sequence; identical to SEQ ID NO: 2395
  Description of Artificial Sequence: Synthetic polypeptide
  VH of XENP022854

SEQ ID NO: 3272 - protein, 108 aa, Artificial Sequence; identical to SEQ ID NO: 2396
  Description of Artificial Sequence: Synthetic polypeptide
  VL of XENP022854

SEQ ID NO: 3273 - protein, 231 aa, Artificial Sequence; identical to SEQ ID NO: 2409
  Description of Artificial Sequence: Synthetic polypeptide
  Fc chain of XENP022854

SEQ ID NO: 3274 - protein, 5 aa, Artificial Sequence
  Description of Artificial Sequence: Synthetic peptide
  XENP022854 vhCDR1
SYTMH

SEQ ID NO: 3275 - protein, 17 aa, Artificial Sequence
  Description of Artificial Sequence: Synthetic peptide
  XENP022854 vhCDR2
FISYDGNYKYYADSVKG

SEQ ID NO: 3276 - protein, 9 aa, Artificial Sequence
  Description of Artificial Sequence: Synthetic peptide
  XENP022854 vhCDR3
GGHLGPFDL

SEQ ID NO: 3277 - protein, 12 aa, Artificial Sequence
  Description of Artificial Sequence: Synthetic peptide
  XENP022854 vlCDR1
RASQSVGSSYLA

SEQ ID NO: 3278 - protein, 7 aa, Artificial Sequence
  Description of Artificial Sequence: Synthetic peptide
  XENP022854 vlCDR2
GASSRAT

SEQ ID NO: 3279 - protein, 9 aa, Artificial Sequence
  Description of Artificial Sequence: Synthetic peptide
  XENP022854 vlCDR3
QQYGSSPWT

SEQ ID NO: 3280 - protein, 219 aa, Artificial Sequence; identical to SEQ ID NO: 6
  Description of Artificial Sequence: Synthetic polypeptide
  XENP022854 1C11_H3L3_Fab-[CTLA-4]_H3.23_L0.129_[CTLA-4]_scFv Light Chain

SEQ ID NO: 3281 - protein, 112 aa, Artificial Sequence; identical to SEQ ID NO: 7
  Description of Artificial Sequence: Synthetic polypeptide
  VL of XENP022854

SEQ ID NO: 3282 - protein, 16 aa, Artificial Sequence
  Description of Artificial Sequence: Synthetic peptide
  XENP022854 vlCDR1
KSSQSIVHSNGNTYLE

SEQ ID NO: 3283 - protein, 7 aa, Artificial Sequence
  Description of Artificial Sequence: Synthetic peptide
  XENP022854 vlCDR2
KVSNRFS

SEQ ID NO: 3284 - protein, 9 aa, Artificial Sequence
  Description of Artificial Sequence: Synthetic peptide
  XENP022854 vlCDR3
FQGSHVPNT

SEQ ID NO: 3285 - protein, 449 aa, Artificial Sequence
  Description of Artificial Sequence: Synthetic polypeptide
  XENP022855 2E9_H1L1_Fab-[CTLA-4]_H3.23_L0.129_[CTLA-4]_scFv Fab-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 3286 - protein, 120 aa, Artificial Sequence; identical to SEQ ID NO: 3091
  Description of Artificial Sequence: Synthetic polypeptide
  VH of XENP022855

SEQ ID NO: 3287 - protein, 5 aa, Artificial Sequence
  Description of Artificial Sequence: Synthetic peptide
  XENP022855 vhCDR1
NYWLG

SEQ ID NO: 3288 - protein, 17 aa, Artificial Sequence
  Description of Artificial Sequence: Synthetic peptide
  XENP022855 vhCDR2
NFYPGSSNTYYNEKFQG

SEQ ID NO: 3289 - protein, 11 aa, Artificial Sequence
  Description of Artificial Sequence: Synthetic peptide
  XENP022855 vhCDR3
HYGTNYRYFDV

SEQ ID NO: 3290 - protein, 477 aa, Artificial Sequence; identical to SEQ ID NO: 2610
  Description of Artificial Sequence: Synthetic polypeptide
  XENP022855 2E9_H1L1_Fab-[CTLA-4]_H3.23_L0.129_[CTLA-4]_scFv scFv-Fc Heavy Chain

SEQ ID NO: 3291 - protein, 118 aa, Artificial Sequence; identical to SEQ ID NO: 2395
  Description of Artificial Sequence: Synthetic polypeptide
  VH of XENP022855

SEQ ID NO: 3292 - protein, 108 aa, Artificial Sequence; identical to SEQ ID NO: 2396
  Description of Artificial Sequence: Synthetic polypeptide
  VL of XENP022855

SEQ ID NO: 3293 - protein, 231 aa, Artificial Sequence; identical to SEQ ID NO: 2409
  Description of Artificial Sequence: Synthetic polypeptide
  Fc chain of XENP022855

SEQ ID NO: 3294 - protein, 5 aa, Artificial Sequence
  Description of Artificial Sequence: Synthetic peptide
  XENP022855 vhCDR1
SYTMH

SEQ ID NO: 3295 - protein, 17 aa, Artificial Sequence
  Description of Artificial Sequence: Synthetic peptide
  XENP022855 vhCDR2
FISYDGNYKYYADSVKG

SEQ ID NO: 3296 - protein, 9 aa, Artificial Sequence
  Description of Artificial Sequence: Synthetic peptide
  XENP022855 vhCDR3
GGHLGPFDL

SEQ ID NO: 3297 - protein, 12 aa, Artificial Sequence
  Description of Artificial Sequence: Synthetic peptide
  XENP022855 vlCDR1
RASQSVGSSYLA

SEQ ID NO: 3298 - protein, 7 aa, Artificial Sequence
  Description of Artificial Sequence: Synthetic peptide
  XENP022855 vlCDR2
GASSRAT

SEQ ID NO: 3299 - protein, 9 aa, Artificial Sequence
  Description of Artificial Sequence: Synthetic peptide
  XENP022855 vlCDR3
QQYGSSPWT

SEQ ID NO: 3300 - protein, 214 aa, Artificial Sequence; identical to SEQ ID NO: 3140
  Description of Artificial Sequence: Synthetic polypeptide
  XENP022855 2E9_H1L1_Fab-[CTLA-4]_H3.23_L0.129_[CTLA-4]_scFv Light Chain

SEQ ID NO: 3301 - protein, 107 aa, Artificial Sequence; identical to SEQ ID NO: 3092
  Description of Artificial Sequence: Synthetic polypeptide
  VL of XENP022855

SEQ ID NO: 3302 - protein, 11 aa, Artificial Sequence
  Description of Artificial Sequence: Synthetic peptide
  XENP022855 vlCDR1
RASQSVSNDVA

SEQ ID NO: 3303 - protein, 7 aa, Artificial Sequence
  Description of Artificial Sequence: Synthetic peptide
  XENP022855 vlCDR2
YASNRYT

SEQ ID NO: 3304 - protein, 9 aa, Artificial Sequence
  Description of Artificial Sequence: Synthetic peptide
  XENP022855 vlCDR3
QQDYSSPYT

SEQ ID NO: 3305 - protein, 446 aa, Artificial Sequence; identical to SEQ ID NO: 3225
  Description of Artificial Sequence: Synthetic polypeptide
  XENP022993 1C11_H3L1_Fab-[CTLA-4]_H3.23_L0.129_scFv Fab-Fc Heavy Chain

SEQ ID NO: 3306 - protein, 117 aa, Artificial Sequence; identical to SEQ ID NO: 32
  Description of Artificial Sequence: Synthetic polypeptide
  VH of XENP022993

SEQ ID NO: 3307 - protein, 5 aa, Artificial Sequence
  Description of Artificial Sequence: Synthetic peptide
  XENP022993 vhCDR1
HYGMN

SEQ ID NO: 3308 - protein, 17 aa, Artificial Sequence
  Description of Artificial Sequence: Synthetic peptide
  XENP022993 vhCDR2
WINTYTGEPTYADGFTG

SEQ ID NO: 3309 - protein, 8 aa, Artificial Sequence
  Description of Artificial Sequence: Synthetic peptide
  XENP022993 vhCDR3
DYYGSSPY

SEQ ID NO: 3310 - protein, 477 aa, Artificial Sequence; identical to SEQ ID NO: 2394
  Description of Artificial Sequence: Synthetic polypeptide
  XENP022993 1C11_H3L1_Fab-[CTLA-4]_H3.23_L0.129_scFv scFv-Fc Heavy Chain

SEQ ID NO: 3311 - protein, 118 aa, Artificial Sequence; identical to SEQ ID NO: 2395
  Description of Artificial Sequence: Synthetic polypeptide
  VH of XENP022993

SEQ ID NO: 3312 - protein, 108 aa, Artificial Sequence; identical to SEQ ID NO: 2396
  Description of Artificial Sequence: Synthetic polypeptide
  VL of XENP022993

SEQ ID NO: 3313 - protein, 231 aa, Artificial Sequence; identical to SEQ ID NO: 2397
  Description of Artificial Sequence: Synthetic polypeptide
  Fc chain of XENP022993

SEQ ID NO: 3314 - protein, 5 aa, Artificial Sequence
  Description of Artificial Sequence: Synthetic peptide
  XENP022993 vhCDR1
SYTMH

SEQ ID NO: 3315 - protein, 17 aa, Artificial Sequence
  Description of Artificial Sequence: Synthetic peptide
  XENP022993 vhCDR2
FISYDGNYKYYADSVKG

SEQ ID NO: 3316 - protein, 9 aa, Artificial Sequence
  Description of Artificial Sequence: Synthetic peptide
  XENP022993 vhCDR3
GGHLGPFDL

SEQ ID NO: 3317 - protein, 12 aa, Artificial Sequence
  Description of Artificial Sequence: Synthetic peptide
  XENP022993 vlCDR1
RASQSVGSSYLA

SEQ ID NO: 3318 - protein, 7 aa, Artificial Sequence
  Description of Artificial Sequence: Synthetic peptide
  XENP022993 vlCDR2
GASSRAT

SEQ ID NO: 3319 - protein, 9 aa, Artificial Sequence
  Description of Artificial Sequence: Synthetic peptide
  XENP022993 vlCDR3
QQYGSSPWT

SEQ ID NO: 3320 - protein, 219 aa, Artificial Sequence; identical to SEQ ID NO: 16
  Description of Artificial Sequence: Synthetic polypeptide
  XENP022993 1C11_H3L1_Fab-[CTLA-4]_H3.23_L0.129_scFv Light Chain

SEQ ID NO: 3321 - protein, 112 aa, Artificial Sequence; identical to SEQ ID NO: 17
  Description of Artificial Sequence: Synthetic polypeptide
  VL of XENP022993

SEQ ID NO: 3322 - protein, 16 aa, Artificial Sequence
  Description of Artificial Sequence: Synthetic peptide
  XENP022993 vlCDR1
RSSQSIVHSNGNTYLE

SEQ ID NO: 3323 - protein, 7 aa, Artificial Sequence
  Description of Artificial Sequence: Synthetic peptide
  XENP022993 vlCDR2
KVSNRFS

SEQ ID NO: 3324 - protein, 9 aa, Artificial Sequence
  Description of Artificial Sequence: Synthetic peptide
  XENP022993 vlCDR3
FQGSHVPNT

SEQ ID NO: 3325 - protein, 446 aa, Artificial Sequence; identical to SEQ ID NO: 3225
  Description of Artificial Sequence: Synthetic polypeptide
  XENP022994 1C11_H3L2_Fab-[CTLA-4]_H3.23_L0.129_scFv Fab-Fc Heavy Chain

SEQ ID NO: 3326 - protein, 117 aa, Artificial Sequence; identical to SEQ ID NO: 32
  Description of Artificial Sequence: Synthetic polypeptide
  VH of XENP022994

SEQ ID NO: 3327 - protein, 5 aa, Artificial Sequence
  Description of Artificial Sequence: Synthetic peptide
  XENP022994 vhCDR1
HYGMN

SEQ ID NO: 3328 - protein, 17 aa, Artificial Sequence
  Description of Artificial Sequence: Synthetic peptide
  XENP022994 vhCDR2
WINTYTGEPTYADGFTG

SEQ ID NO: 3329 - protein, 8 aa, Artificial Sequence
  Description of Artificial Sequence: Synthetic peptide
  XENP022994 vhCDR3
DYYGSSPY

SEQ ID NO: 3330 - protein, 477 aa, Artificial Sequence; identical to SEQ ID NO: 2394
  Description of Artificial Sequence: Synthetic polypeptide
  XENP022994 1C11_H3L2_Fab-[CTLA-4]_H3.23_L0.129_scFv scFv-Fc Heavy Chain

SEQ ID NO: 3331 - protein, 118 aa, Artificial Sequence; identical to SEQ ID NO: 2395
  Description of Artificial Sequence: Synthetic polypeptide
  VH of XENP022994

SEQ ID NO: 3332 - protein, 108 aa, Artificial Sequence; identical to SEQ ID NO: 2396
  Description of Artificial Sequence: Synthetic polypeptide
  VL of XENP022994

SEQ ID NO: 3333 - protein, 231 aa, Artificial Sequence; identical to SEQ ID NO: 2397
  Description of Artificial Sequence: Synthetic polypeptide
  Fc chain of XENP022994

SEQ ID NO: 3334 - protein, 5 aa, Artificial Sequence
  Description of Artificial Sequence: Synthetic peptide
  XENP022994 vhCDR1
SYTMH

SEQ ID NO: 3335 - protein, 17 aa, Artificial Sequence
  Description of Artificial Sequence: Synthetic peptide
  XENP022994 vhCDR2
FISYDGNYKYYADSVKG

SEQ ID NO: 3336 - protein, 9 aa, Artificial Sequence
  Description of Artificial Sequence: Synthetic peptide
  XENP022994 vhCDR3
GGHLGPFDL

SEQ ID NO: 3337 - protein, 12 aa, Artificial Sequence
  Description of Artificial Sequence: Synthetic peptide
  XENP022994 vlCDR1
RASQSVGSSYLA

SEQ ID NO: 3338 - protein, 7 aa, Artificial Sequence
  Description of Artificial Sequence: Synthetic peptide
  XENP022994 vlCDR2
GASSRAT

SEQ ID NO: 3339 - protein, 9 aa, Artificial Sequence
  Description of Artificial Sequence: Synthetic peptide
  XENP022994 vlCDR3
QQYGSSPWT

SEQ ID NO: 3340 - protein, 219 aa, Artificial Sequence; identical to SEQ ID NO: 26
  Description of Artificial Sequence: Synthetic polypeptide
  XENP022994 1C11_H3L2_Fab-[CTLA-4]_H3.23_L0.129_scFv Light Chain

SEQ ID NO: 3341 - protein, 112 aa, Artificial Sequence; identical to SEQ ID NO: 27
  Description of Artificial Sequence: Synthetic polypeptide
  VL of XENP022994

SEQ ID NO: 3342 - protein, 16 aa, Artificial Sequence
  Description of Artificial Sequence: Synthetic peptide
  XENP022994 vlCDR1
RSSQSIVHSNGNTYLE

SEQ ID NO: 3343 - protein, 7 aa, Artificial Sequence
  Description of Artificial Sequence: Synthetic peptide
  XENP022994 vlCDR2
KVSNRFS

SEQ ID NO: 3344 - protein, 9 aa, Artificial Sequence
  Description of Artificial Sequence: Synthetic peptide
  XENP022994 vlCDR3
FQGSHVPNT

SEQ ID NO: 3345 - protein, 446 aa, Artificial Sequence
  Description of Artificial Sequence: Synthetic polypeptide
  XENP020850 1D12_H1L1_IgG1_PVA_/S267K Heavy Chain
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3346 - protein, 117 aa, Artificial Sequence
  Description of Artificial Sequence: Synthetic polypeptide
  VH of XENP020850
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSS

SEQ ID NO: 3347 - protein, 5 aa, Artificial Sequence
  Description of Artificial Sequence: Synthetic peptide
  XENP020850 vhCDR1
SYTMH

SEQ ID NO: 3348 - protein, 17 aa, Artificial Sequence
  Description of Artificial Sequence: Synthetic peptide
  XENP020850 vhCDR2
YLIPSSGYTDYNQKFQG

SEQ ID NO: 3349 - protein, 8 aa, Artificial Sequence
  Description of Artificial Sequence: Synthetic peptide
  XENP020850 vhCDR3
GDSVYFDY

SEQ ID NO: 3350 - protein, 218 aa, Artificial Sequence
  Description of Artificial Sequence: Synthetic polypeptide
  XENP020850 1D12_H1L1_IgG1_PVA_/S267K Light Chain
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3351 - protein, 111 aa, Artificial Sequence
  Description of Artificial Sequence: Synthetic polypeptide
  VL of XENP020850
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIK

SEQ ID NO: 3352 - protein, 15 aa, Artificial Sequence
  Description of Artificial Sequence: Synthetic peptide
  XENP020850 vlCDR1
RASESVEYYGTSLMQ

SEQ ID NO: 3353 - protein, 7 aa, Artificial Sequence
  Description of Artificial Sequence: Synthetic peptide
  XENP020850 vlCDR2
AASNVES

SEQ ID NO: 3354 - protein, 9 aa, Artificial Sequence
  Description of Artificial Sequence: Synthetic peptide
  XENP020850 vlCDR3
QQSRKVPWT

SEQ ID NO: 3355 - protein, 446 aa, Artificial Sequence; identical to SEQ ID NO: 3345
  Description of Artificial Sequence: Synthetic polypeptide
  XENP020851 1D12_H1L2_IgG1_PVA_/S267K Heavy Chain

SEQ ID NO: 3356 - protein, 117 aa, Artificial Sequence; identical to SEQ ID NO: 3346
  Description of Artificial Sequence: Synthetic polypeptide
  VH of XENP020851

SEQ ID NO: 3357 - protein, 5 aa, Artificial Sequence
  Description of Artificial Sequence: Synthetic peptide
  XENP020851 vhCDR1
SYTMH

SEQ ID NO: 3358 - protein, 17 aa, Artificial Sequence
  Description of Artificial Sequence: Synthetic peptide
  XENP020851 vhCDR2
YLIPSSGYTDYNQKFQG

SEQ ID NO: 3359 - protein, 8 aa, Artificial Sequence
  Description of Artificial Sequence: Synthetic peptide
  XENP020851 vhCDR3
GDSVYFDY

SEQ ID NO: 3360 - protein, 218 aa, Artificial Sequence
  Description of Artificial Sequence: Synthetic polypeptide
  XENP020851 1D12_H1L2_IgG1_PVA_/S267K Light Chain
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3361 - protein, 111 aa, Artificial Sequence
  Description of Artificial Sequence: Synthetic polypeptide
  VL of XENP020851
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIK

SEQ ID NO: 3362 - protein, 15 aa, Artificial Sequence
  Description of Artificial Sequence: Synthetic peptide
  XENP020851 vlCDR1
KASESVEYYGTSLMQ

SEQ ID NO: 3363 - protein, 7 aa, Artificial Sequence
  Description of Artificial Sequence: Synthetic peptide
  XENP020851 vlCDR2
AASNVES

SEQ ID NO: 3364 - protein, 9 aa, Artificial Sequence
  Description of Artificial Sequence: Synthetic peptide
  XENP020851 vlCDR3
QQSRKVPWT

SEQ ID NO: 3365 - protein, 446 aa, Artificial Sequence
  Description of Artificial Sequence: Synthetic polypeptide
  XENP020853 3H3_H1L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3366 - protein, 117 aa, Artificial Sequence
  Description of Artificial Sequence: Synthetic polypeptide
  VH of XENP020853
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSS

SEQ ID NO: 3367 - protein, 5 aa, Artificial Sequence
  Description of Artificial Sequence: Synthetic peptide
  XENP020853 vhCDR1
GYGVN

SEQ ID NO: 3368 - protein, 16 aa, Artificial Sequence
  Description of Artificial Sequence: Synthetic peptide
  XENP020853 vhCDR2
MIWGDGSTDYNSALKS

SEQ ID NO: 3369 - protein, 9 aa, Artificial Sequence
  Description of Artificial Sequence: Synthetic peptide
  XENP020853 vhCDR3
SYYTSDEDY

SEQ ID NO: 3370 - protein, 219 aa, Artificial Sequence
  Description of Artificial Sequence: Synthetic polypeptide
  XENP020853 3H3_H1L1_IgG1_PVA_/S267K Light Chain
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3371 - protein, 112 aa, Artificial Sequence
  Description of Artificial Sequence: Synthetic polypeptide
  VL of XENP020853
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 3372 - protein, 17 aa, Artificial Sequence
  Description of Artificial Sequence: Synthetic peptide
  XENP020853 vlCDR1
RSSQSLLNSRTRKNYLA

SEQ ID NO: 3373 - protein, 7 aa, Artificial Sequence
  Description of Artificial Sequence: Synthetic peptide
  XENP020853 vlCDR2
WASTRES

SEQ ID NO: 3374 - protein, 8 aa, Artificial Sequence
  Description of Artificial Sequence: Synthetic peptide
  XENP020853 vlCDR3
KQSYSLRT

SEQ ID NO: 3375 - protein, 446 aa, Artificial Sequence; identical to SEQ ID NO: 3365
  Description of Artificial Sequence: Synthetic polypeptide
  XENP020854 3H3_H1L2_IgG1_PVA_/S267K Heavy Chain

SEQ ID NO: 3376 - protein, 117 aa, Artificial Sequence; identical to SEQ ID NO: 3366
  Description of Artificial Sequence: Synthetic polypeptide
  VH of XENP020854

SEQ ID NO: 3377 - protein, 5 aa, Artificial Sequence
  Description of Artificial Sequence: Synthetic peptide
  XENP020854 vhCDR1
GYGVN

SEQ ID NO: 3378 - protein, 16 aa, Artificial Sequence
  Description of Artificial Sequence: Synthetic peptide
  XENP020854 vhCDR2
MIWGDGSTDYNSALKS

SEQ ID NO: 3379 - protein, 9 aa, Artificial Sequence
  Description of Artificial Sequence: Synthetic peptide
  XENP020854 vhCDR3
SYYTSDEDY

SEQ ID NO: 3380 - protein, 219 aa, Artificial Sequence
  Description of Artificial Sequence: Synthetic polypeptide
  XENP020854 3H3_H1L2_IgG1_PVA_/S267K Light Chain
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3381 - protein, 112 aa, Artificial Sequence
  Description of Artificial Sequence: Synthetic polypeptide
  VL of XENP020854
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 3382 - protein, 17 aa, Artificial Sequence
  Description of Artificial Sequence: Synthetic peptide
  XENP020854 vlCDR1
KSSQSLLNSRTRKNYLA

SEQ ID NO: 3383 - protein, 7 aa, Artificial Sequence
  Description of Artificial Sequence: Synthetic peptide
  XENP020854 vlCDR2
WASTRES

SEQ ID NO: 3384 - protein, 8 aa, Artificial Sequence
  Description of Artificial Sequence: Synthetic peptide
  XENP020854 vlCDR3
KQSYSLRT

SEQ ID NO: 3385 - protein, 446 aa, Artificial Sequence
  Description of Artificial Sequence: Synthetic polypeptide
  XENP020855 3H3_H2L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3386 - protein, 117 aa, Artificial Sequence
  Description of Artificial Sequence: Synthetic polypeptide
  VH of XENP020855
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSS

SEQ ID NO: 3387 - protein, 5 aa, Artificial Sequence
  Description of Artificial Sequence: Synthetic peptide
  XENP020855 vhCDR1
GYGVN

SEQ ID NO: 3388 - protein, 16 aa, Artificial Sequence
  Description of Artificial Sequence: Synthetic peptide
  XENP020855 vhCDR2
MIWGDGSTDYNSALKS

SEQ ID NO: 3389 - protein, 9 aa, Artificial Sequence
  Description of Artificial Sequence: Synthetic peptide
  XENP020855 vhCDR3
SYYTSDFDY

SEQ ID NO: 3390 - protein, 219 aa, Artificial Sequence; identical to SEQ ID NO: 3370
  Description of Artificial Sequence: Synthetic polypeptide
  XENP020855 3H3_H2L1_IgG1_PVA_/S267K Light Chain

SEQ ID NO: 3391 - protein, 112 aa, Artificial Sequence; identical to SEQ ID NO: 3371
  Description of Artificial Sequence: Synthetic polypeptide
  VL of XENP020855

SEQ ID NO: 3392 - protein, 17 aa, Artificial Sequence
  Description of Artificial Sequence: Synthetic peptide
  XENP020855 vlCDR1
RSSQSLLNSRTRKNYLA

SEQ ID NO: 3393 - protein, 7 aa, Artificial Sequence
  Description of Artificial Sequence: Synthetic peptide
  XENP020855 vlCDR2
WASTRES

SEQ ID NO: 3394 - protein, 8 aa, Artificial Sequence
  Description of Artificial Sequence: Synthetic peptide
  XENP020855 vlCDR3
KQSYSLRT

SEQ ID NO: 3395 - protein, 446 aa, Artificial Sequence; identical to SEQ ID NO: 3385
  Description of Artificial Sequence: Synthetic polypeptide
  XENP020856 3H3_H2L2_IgG1_PVA_/S267K Heavy Chain

SEQ ID NO: 3396 - protein, 117 aa, Artificial Sequence; identical to SEQ ID NO: 3386
  Description of Artificial Sequence: Synthetic polypeptide
  VH of XENP020856

SEQ ID NO: 3397 - protein, 5 aa, Artificial Sequence
  Description of Artificial Sequence: Synthetic peptide
  XENP020856 vhCDR1
GYGVN

SEQ ID NO: 3398 - protein, 16 aa, Artificial Sequence
  Description of Artificial Sequence: Synthetic peptide
  XENP020856 vhCDR2
MIWGDGSTDYNSALKS

SEQ ID NO: 3399 - protein, 9 aa, Artificial Sequence
  Description of Artificial Sequence: Synthetic peptide
  XENP020856 vhCDR3
SYYTSDFDY

SEQ ID NO: 3400 - protein, 219 aa, Artificial Sequence; identical to SEQ ID NO: 3380
  Description of Artificial Sequence: Synthetic polypeptide
  XENP020856 3H3_H2L2_IgG1_PVA_/S267K Light Chain

SEQ ID NO: 3401 - protein, 112 aa, Artificial Sequence; identical to SEQ ID NO: 3381
  Description of Artificial Sequence: Synthetic polypeptide
  VL of XENP020856

SEQ ID NO: 3402 - protein, 17 aa, Artificial Sequence
  Description of Artificial Sequence: Synthetic peptide
  XENP020856 vlCDR1
KSSQSLLNSRTRKNYLA

SEQ ID NO: 3403 - protein, 7 aa, Artificial Sequence
  Description of Artificial Sequence: Synthetic peptide
  XENP020856 vlCDR2
WASTRES

SEQ ID NO: 3404 - protein, 8 aa, Artificial Sequence
  Description of Artificial Sequence: Synthetic peptide
  XENP020856 vlCDR3
KQSYSLRT

SEQ ID NO: 3405 - protein, 446 aa, Artificial Sequence
  Description of Artificial Sequence: Synthetic polypeptide
  XENP020857 3H3_H3L1_IgG1_PVA_/S267K Heavy Chain
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3406 - protein, 117 aa, Artificial Sequence
  Description of Artificial Sequence: Synthetic polypeptide
  VH of XENP020857
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSS

SEQ ID NO: 3407 - protein, 5 aa, Artificial Sequence
  Description of Artificial Sequence: Synthetic peptide
  XENP020857 vhCDR1
GYGVN

SEQ ID NO: 3408 - protein, 16 aa, Artificial Sequence
  Description of Artificial Sequence: Synthetic peptide
  XENP020857 vhCDR2
MIWGDGSTDYNSAVKG

SEQ ID NO: 3409 - protein, 9 aa, Artificial Sequence
  Description of Artificial Sequence: Synthetic peptide
  XENP020857 vhCDR3
SYYTSDEDY

SEQ ID NO: 3410 - protein, 219 aa, Artificial Sequence; identical to SEQ ID NO: 3370
  Description of Artificial Sequence: Synthetic polypeptide
  XENP020857 3H3_H3L1_IgG1_PVA_/S267K Light Chain

SEQ ID NO: 3411 - protein, 112 aa, Artificial Sequence; identical to SEQ ID NO: 3371
  Description of Artificial Sequence: Synthetic polypeptide
  VL of XENP020857

SEQ ID NO: 3412 - protein, 17 aa, Artificial Sequence
  Description of Artificial Sequence: Synthetic peptide
  XENP020857 vlCDR1
RSSQSLLNSRTRKNYLA

SEQ ID NO: 3413 - protein, 7 aa, Artificial Sequence
  Description of Artificial Sequence: Synthetic peptide
  XENP020857 vlCDR2
WASTRES

SEQ ID NO: 3414 - protein, 8 aa, Artificial Sequence
  Description of Artificial Sequence: Synthetic peptide
  XENP020857 vlCDR3
KQSYSLRT

SEQ ID NO: 3415 - protein, 446 aa, Artificial Sequence; identical to SEQ ID NO: 3405
  Description of Artificial Sequence: Synthetic polypeptide
  XENP020858 3H3_H3L2_IgG1_PVA_/S267K Heavy Chain

SEQ ID NO: 3416 - protein, 117 aa, Artificial Sequence; identical to SEQ ID NO: 3406
  Description of Artificial Sequence: Synthetic polypeptide
  VH of XENP020858

SEQ ID NO: 3417 - protein, 5 aa, Artificial Sequence
  Description of Artificial Sequence: Synthetic peptide
  XENP020858 vhCDR1
GYGVN

SEQ ID NO: 3418 - protein, 16 aa, Artificial Sequence
  Description of Artificial Sequence: Synthetic peptide
  XENP020858 vhCDR2
MIWGDGSTDYNSAVKG

SEQ ID NO: 3419 - protein, 9 aa, Artificial Sequence
  Description of Artificial Sequence: Synthetic peptide
  XENP020858 vhCDR3
SYYTSDEDY

SEQ ID NO: 3420 - protein, 219 aa, Artificial Sequence; identical to SEQ ID NO: 3380
  Description of Artificial Sequence: Synthetic polypeptide
  XENP020858 3H3_H3L2_IgG1_PVA_/S267K Light Chain

SEQ ID NO: 3421 - protein, 112 aa, Artificial Sequence; identical to SEQ ID NO: 3381
  Description of Artificial Sequence: Synthetic polypeptide
  VL of XENP020858

SEQ ID NO: 3422 - protein, 17 aa, Artificial Sequence
  Description of Artificial Sequence: Synthetic peptide
  XENP020858 vlCDR1
KSSQSLLNSRTRKNYLA

SEQ ID NO: 3423 - protein, 7 aa, Artificial Sequence
  Description of Artificial Sequence: Synthetic peptide
  XENP020858 vlCDR2
WASTRES

SEQ ID NO: 3424 - protein, 8 aa, Artificial Sequence
  Description of Artificial Sequence: Synthetic peptide
  XENP020858 vlCDR3
KQSYSLRT

SEQ ID NO: 3425 - protein, 446 aa, Artificial Sequence
  Description of Artificial Sequence: Synthetic polypeptide
  XENP020859 3H3_H4L1_IgG1_PVA_/S267K Heavy Chain
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3426 - protein, 117 aa, Artificial Sequence
  Description of Artificial Sequence: Synthetic polypeptide
  VH of XENP020859
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSS

SEQ ID NO: 3427 - protein, 5 aa, Artificial Sequence
  Description of Artificial Sequence: Synthetic peptide
  XENP020859 vhCDR1
GYGVN

SEQ ID NO: 3428 - protein, 16 aa, Artificial Sequence
  Description of Artificial Sequence: Synthetic peptide
  XENP020859 vhCDR2
MIWGDGSTDYNPSLKS

SEQ ID NO: 3429 - protein, 9 aa, Artificial Sequence
  Description of Artificial Sequence: Synthetic peptide
  XENP020859 vhCDR3
SYYTSDEDY

SEQ ID NO: 3430 - protein, 219 aa, Artificial Sequence; identical to SEQ ID NO: 3370
  Description of Artificial Sequence: Synthetic polypeptide
  XENP020859 3H3_H4L1_IgG1_PVA_/S267K Light Chain

SEQ ID NO: 3431 - protein, 112 aa, Artificial Sequence; identical to SEQ ID NO: 3371
  Description of Artificial Sequence: Synthetic polypeptide
  VL of XENP020859

SEQ ID NO: 3432 - protein, 17 aa, Artificial Sequence
  Description of Artificial Sequence: Synthetic peptide
  XENP020859 vlCDR1
RSSQSLLNSRTRKNYLA

SEQ ID NO: 3433 - protein, 7 aa, Artificial Sequence
  Description of Artificial Sequence: Synthetic peptide
  XENP020859 vlCDR2
WASTRES

SEQ ID NO: 3434 - protein, 8 aa, Artificial Sequence
  Description of Artificial Sequence: Synthetic peptide
  XENP020859 vlCDR3
KQSYSLRT

SEQ ID NO: 3435 - protein, 446 aa, Artificial Sequence; identical to SEQ ID NO: 3425
  Description of Artificial Sequence: Synthetic polypeptide
  XENP020860 3H3_H4L2_IgG1_PVA_/S267K Heavy Chain

SEQ ID NO: 3436 - protein, 117 aa, Artificial Sequence; identical to SEQ ID NO: 3426
  Description of Artificial Sequence: Synthetic polypeptide
  VH of XENP020860

SEQ ID NO: 3437 - protein, 5 aa, Artificial Sequence
  Description of Artificial Sequence: Synthetic peptide
  XENP020860 vhCDR1
GYGVN

SEQ ID NO: 3438 - protein, 16 aa, Artificial Sequence
  Description of Artificial Sequence: Synthetic peptide
  XENP020860 vhCDR2
MIWGDGSTDYNPSLKS

SEQ ID NO: 3439 - protein, 9 aa, Artificial Sequence
  Description of Artificial Sequence: Synthetic peptide
  XENP020860 vhCDR3
SYYTSDEDY

SEQ ID NO: 3440 - protein, 219 aa, Artificial Sequence; identical to SEQ ID NO: 3380
  Description of Artificial Sequence: Synthetic polypeptide
  XENP020860 3H3_H4L2_IgG1_PVA_/S267K Light Chain

SEQ ID NO: 3441 - protein, 112 aa, Artificial Sequence; identical to SEQ ID NO: 3381
  Description of Artificial Sequence: Synthetic polypeptide
  VL of XENP020860

SEQ ID NO: 3442 - protein, 17 aa, Artificial Sequence
  Description of Artificial Sequence: Synthetic peptide
  XENP020860 vlCDR1
KSSQSLLNSRTRKNYLA

SEQ ID NO: 3443 - protein, 7 aa, Artificial Sequence
  Description of Artificial Sequence: Synthetic peptide
  XENP020860 vlCDR2
WASTRES

SEQ ID NO: 3444 - protein, 8 aa, Artificial Sequence
  Description of Artificial Sequence: Synthetic peptide
  XENP020860 vlCDR3
KQSYSLRT

SEQ ID NO: 3445 - protein, 447 aa, Artificial Sequence
  Description of Artificial Sequence: Synthetic polypeptide
  XENP020861 7B11_H1L1_IgG1_PVA_/S267K Heavy Chain
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3446 - protein, 118 aa, Artificial Sequence
  Description of Artificial Sequence: Synthetic polypeptide
  VH of XENP020861
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSS

SEQ ID NO: 3447 - protein, 5 aa, Artificial Sequence
  Description of Artificial Sequence: Synthetic peptide
  XENP020861 vhCDR1
SYAVN

SEQ ID NO: 3448 - protein, 16 aa, Artificial Sequence
  Description of Artificial Sequence: Synthetic peptide
  XENP020861 vhCDR2
VIWSGGSTDYNAKFQG

SEQ ID NO: 3449 - protein, 10 aa, Artificial Sequence
  Description of Artificial Sequence: Synthetic peptide
  XENP020861 vhCDR3
LYYRYDGFDY

SEQ ID NO: 3450 - protein, 214 aa, Artificial Sequence
  Description of Artificial Sequence: Synthetic polypeptide
  XENP020861 7B11_H1L1_IgG1_PVA_/S267K Light Chain
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3451 - protein, 107 aa, Artificial Sequence
  Description of Artificial Sequence: Synthetic polypeptide
  VL of XENP020861
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIK

SEQ ID NO: 3452 - protein, 11 aa, Artificial Sequence
  Description of Artificial Sequence: Synthetic peptide
  XENP020861 vlCDR1
RASQNVGTHVA

SEQ ID NO: 3453 - protein, 7 aa, Artificial Sequence
  Description of Artificial Sequence: Synthetic peptide
  XENP020861 vlCDR2
SASYRYS

SEQ ID NO: 3454 - protein, 9 aa, Artificial Sequence
  Description of Artificial Sequence: Synthetic peptide
  XENP020861 vlCDR3
QQYNSYPLT

SEQ ID NO: 3455 - protein, 447 aa, Artificial Sequence; identical to SEQ ID NO: 3445
  Description of Artificial Sequence: Synthetic polypeptide
  XENP020862 7B11_H1L2_IgG1_PVA_/S267K Heavy Chain

SEQ ID NO: 3456 - protein, 118 aa, Artificial Sequence; identical to SEQ ID NO: 3446
  Description of Artificial Sequence: Synthetic polypeptide
  VH of XENP020862

SEQ ID NO: 3457 - protein, 5 aa, Artificial Sequence
  Description of Artificial Sequence: Synthetic peptide
  XENP020862 vhCDR1
SYAVN

SEQ ID NO: 3458 - protein, 16 aa, Artificial Sequence
  Description of Artificial Sequence: Synthetic peptide
  XENP020862 vhCDR2
VIWSGGSTDYNAKFQG

SEQ ID NO: 3459 - protein, 10 aa, Artificial Sequence
  Description of Artificial Sequence: Synthetic peptide
  XENP020862 vhCDR3
LYYRYDGFDY

SEQ ID NO: 3460 - protein, 214 aa, Artificial Sequence
  Description of Artificial Sequence: Synthetic polypeptide
  XENP020862 7B11_H1L2_IgG1_PVA_/S267K Light Chain
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3461 - protein, 107 aa, Artificial Sequence
  Description of Artificial Sequence: Synthetic polypeptide
  VL of XENP020862
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIK

SEQ ID NO: 3462 - protein, 11 aa, Artificial Sequence
  Description of Artificial Sequence: Synthetic peptide
  XENP020862 vlCDR1
KASQNVGTHVA

SEQ ID NO: 3463 - protein, 7 aa, Artificial Sequence
  Description of Artificial Sequence: Synthetic peptide
  XENP020862 vlCDR2
SASYRYS

SEQ ID NO: 3464 - protein, 9 aa, Artificial Sequence
  Description of Artificial Sequence: Synthetic peptide
  XENP020862 vlCDR3
QQYNSYPLT

SEQ ID NO: 3465 - protein, 447 aa, Artificial Sequence
  Description of Artificial Sequence: Synthetic polypeptide
  XENP020863 7B11_H2L1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3466 - protein, 118 aa, Artificial Sequence
  Description of Artificial Sequence: Synthetic polypeptide
  VH of XENP020863
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSS

SEQ ID NO: 3467 - protein, 5 aa, Artificial Sequence
  Description of Artificial Sequence: Synthetic peptide
  XENP020863 vhCDR1
SYAVN

SEQ ID NO: 3468 - protein, 16 aa, Artificial Sequence
  Description of Artificial Sequence: Synthetic peptide
  XENP020863 vhCDR2
VIWSGGSTDYNPSVKG

SEQ ID NO: 3469 - protein, 10 aa, Artificial Sequence
  Description of Artificial Sequence: Synthetic peptide
  XENP020863 vhCDR3
LYYRYDGFDY

SEQ ID NO: 3470 - protein, 214 aa, Artificial Sequence; identical to SEQ ID NO: 3450
  Description of Artificial Sequence: Synthetic polypeptide
  XENP020863 7B11_H2L1_IgG1_PVA_/S267K Light Chain

SEQ ID NO: 3471 - protein, 107 aa, Artificial Sequence; identical to SEQ ID NO: 3451
  Description of Artificial Sequence: Synthetic polypeptide
  VL of XENP020863

SEQ ID NO: 3472 - protein, 11 aa, Artificial Sequence
  Description of Artificial Sequence: Synthetic peptide
  XENP020863 vlCDR1
RASQNVGTHVA

SEQ ID NO: 3473 - protein, 7 aa, Artificial Sequence
  Description of Artificial Sequence: Synthetic peptide
  XENP020863 vlCDR2
SASYRYS

SEQ ID NO: 3474 - protein, 9 aa, Artificial Sequence
  Description of Artificial Sequence: Synthetic peptide
  XENP020863 vlCDR3
QQYNSYPLT

SEQ ID NO: 3475 - protein, 447 aa, Artificial Sequence; identical to SEQ ID NO: 3465
  Description of Artificial Sequence: Synthetic polypeptide
  XENP020864 7B11_H2L2_IgG1_PVA_/S267K Heavy Chain

SEQ ID NO: 3476 - protein, 118 aa, Artificial Sequence; identical to SEQ ID NO: 3466
  Description of Artificial Sequence: Synthetic polypeptide
  VH of XENP020864

SEQ ID NO: 3477 - protein, 5 aa, Artificial Sequence
  Description of Artificial Sequence: Synthetic peptide
  XENP020864 vhCDR1
SYAVN

SEQ ID NO: 3478 - protein, 16 aa, Artificial Sequence
  Description of Artificial Sequence: Synthetic peptide
  XENP020864 vhCDR2
VIWSGGSTDYNPSVKG

SEQ ID NO: 3479 - protein, 10 aa, Artificial Sequence
  Description of Artificial Sequence: Synthetic peptide
  XENP020864 vhCDR3
LYYRYDGFDY

SEQ ID NO: 3480 - protein, 214 aa, Artificial Sequence; identical to SEQ ID NO: 3460
  Description of Artificial Sequence: Synthetic polypeptide
  XENP020864 7B11_H2L2_IgG1_PVA_/S267K Light Chain

SEQ ID NO: 3481 - protein, 107 aa, Artificial Sequence; identical to SEQ ID NO: 3461
  Description of Artificial Sequence: Synthetic polypeptide
  VL of XENP020864

SEQ ID NO: 3482 - protein, 11 aa, Artificial Sequence
  Description of Artificial Sequence: Synthetic peptide
  XENP020864 vlCDR1
KASQNVGTHVA

SEQ ID NO: 3483 - protein, 7 aa, Artificial Sequence
  Description of Artificial Sequence: Synthetic peptide
  XENP020864 vlCDR2
SASYRYS

SEQ ID NO: 3484 - protein, 9 aa, Artificial Sequence
  Description of Artificial Sequence: Synthetic peptide
  XENP020864 vlCDR3
QQYNSYPLT

SEQ ID NO: 3485 - protein, 446 aa, Artificial Sequence
  Description of Artificial Sequence: Synthetic polypeptide
  XENP020865 7C2_H1L1_IgG1_PVA_/S267K Heavy Chain
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3486 - protein, 117 aa, Artificial Sequence
  Description of Artificial Sequence: Synthetic polypeptide
  VH of XENP020865
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSS

SEQ ID NO: 3487 - protein, 5 aa, Artificial Sequence
  Description of Artificial Sequence: Synthetic peptide
  XENP020865 vhCDR1
RYAVS

SEQ ID NO: 3488 - protein, 16 aa, Artificial Sequence
  Description of Artificial Sequence: Synthetic peptide
  XENP020865 vhCDR2
SISSGGSTYYPDSVKG

SEQ ID NO: 3489 - protein, 9 aa, Artificial Sequence
  Description of Artificial Sequence: Synthetic peptide
  XENP020865 vhCDR3
GDYEGYFDY

SEQ ID NO: 3490 - protein, 220 aa, Artificial Sequence
  Description of Artificial Sequence: Synthetic polypeptide
  XENP020865 7C2_H1L1_IgG1_PVA_/S267K Light Chain
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3491 - protein, 113 aa, Artificial Sequence
  Description of Artificial Sequence: Synthetic polypeptide
  VL of XENP020865
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIK

SEQ ID NO: 3492 - protein, 17 aa, Artificial Sequence
  Description of Artificial Sequence: Synthetic peptide
  XENP020865 vlCDR1
KSSQSLLNSINQKNYLA

SEQ ID NO: 3493 - protein, 7 aa, Artificial Sequence
  Description of Artificial Sequence: Synthetic peptide
  XENP020865 vlCDR2
FASTRES

SEQ ID NO: 3494 - protein, 9 aa, Artificial Sequence
  Description of Artificial Sequence: Synthetic peptide
  XENP020865 vlCDR3
QQHYSTPLT

SEQ ID NO: 3495 - protein, 446 aa, Artificial Sequence; identical to SEQ ID NO: 3365
  Description of Artificial Sequence: Synthetic polypeptide
  XENP021188 3H3_H1_L1.1_IgG1_PVA_/S267K Heavy Chain

SEQ ID NO: 3496 - protein, 117 aa, Artificial Sequence; identical to SEQ ID NO: 3366
  Description of Artificial Sequence: Synthetic polypeptide
  VH of XENP021188

SEQ ID NO: 3497 - protein, 5 aa, Artificial Sequence
  Description of Artificial Sequence: Synthetic peptide
  XENP021188 vhCDR1
GYGVN

SEQ ID NO: 3498 - protein, 16 aa, Artificial Sequence
  Description of Artificial Sequence: Synthetic peptide
  XENP021188 vhCDR2
MIWGDGSTDYNSALKS

SEQ ID NO: 3499 - protein, 9 aa, Artificial Sequence
  Description of Artificial Sequence: Synthetic peptide
  XENP021188 vhCDR3
SYYTSDEDY

SEQ ID NO: 3500 - protein, 219 aa, Artificial Sequence
  Description of Artificial Sequence: Synthetic polypeptide
  XENP021188 3H3_H1_L1.1_IgG1_PVA_/S267K Light Chain
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3501 - protein, 112 aa, Artificial Sequence
  Description of Artificial Sequence: Synthetic polypeptide
  VL of XENP021188
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 3502 - protein, 17 aa, Artificial Sequence
  Description of Artificial Sequence: Synthetic peptide
  XENP021188 vlCDR1
RSSQSLLNSRTRKNYLA

SEQ ID NO: 3503 - protein, 7 aa, Artificial Sequence
  Description of Artificial Sequence: Synthetic peptide
  XENP021188 vlCDR2
WASTRES

SEQ ID NO: 3504 - protein, 8 aa, Artificial Sequence
  Description of Artificial Sequence: Synthetic peptide
  XENP021188 vlCDR3
KQSYSLRT

SEQ ID NO: 3505 - protein, 446 aa, Artificial Sequence; identical to SEQ ID NO: 3365
  Description of Artificial Sequence: Synthetic polypeptide
  XENP021189 3H3_H1_L2.1_IgG1_PVA_/S267K Heavy Chain

SEQ ID NO: 3506 - protein, 117 aa, Artificial Sequence; identical to SEQ ID NO: 3366
  Description of Artificial Sequence: Synthetic polypeptide
  VH of XENP021189

SEQ ID NO: 3507 - protein, 5 aa, Artificial Sequence
  Description of Artificial Sequence: Synthetic peptide
  XENP021189 vhCDR1
GYGVN

SEQ ID NO: 3508 - protein, 16 aa, Artificial Sequence
  Description of Artificial Sequence: Synthetic peptide
  XENP021189 vhCDR2
MIWGDGSTDYNSALKS

SEQ ID NO: 3509 - protein, 9 aa, Artificial Sequence
  Description of Artificial Sequence: Synthetic peptide
  XENP021189 vhCDR3
SYYTSDEDY

SEQ ID NO: 3510 - protein, 219 aa, Artificial Sequence
  Description of Artificial Sequence: Synthetic polypeptide
  XENP021189 3H3_H1_L2.1_IgG1_PVA_/S267K Light Chain
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3511 - protein, 112 aa, Artificial Sequence
  Description of Artificial Sequence: Synthetic polypeptide
  VL of XENP021189
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 3512 - protein, 17 aa, Artificial Sequence
  Description of Artificial Sequence: Synthetic peptide
  XENP021189 vlCDR1
KSSQSLLNSRTRKNYLA

SEQ ID NO: 3513 - protein, 7 aa, Artificial Sequence
  Description of Artificial Sequence: Synthetic peptide
  XENP021189 vlCDR2
WASTRES

SEQ ID NO: 3514 - protein, 8 aa, Artificial Sequence
  Description of Artificial Sequence: Synthetic peptide
  XENP021189 vlCDR3
KQSYSLRT

SEQ ID NO: 3515 - protein, 446 aa, Artificial Sequence; identical to SEQ ID NO: 3385
  Description of Artificial Sequence: Synthetic polypeptide
  XENP021190 3H3_H2_L1.1_IgG1_PVA_/S267K Heavy Chain

SEQ ID NO: 3516 - protein, 117 aa, Artificial Sequence; identical to SEQ ID NO: 3386
  Description of Artificial Sequence: Synthetic polypeptide
  VH of XENP021190

SEQ ID NO: 3517 - protein, 5 aa, Artificial Sequence
  Description of Artificial Sequence: Synthetic peptide
  XENP021190 vhCDR1
GYGVN

SEQ ID NO: 3518 - protein, 16 aa, Artificial Sequence
  Description of Artificial Sequence: Synthetic peptide
  XENP021190 vhCDR2
MIWGDGSTDYNSALKS

SEQ ID NO: 3519 - protein, 9 aa, Artificial Sequence
  Description of Artificial Sequence: Synthetic peptide
  XENP021190 vhCDR3
SYYTSDFDY

SEQ ID NO: 3520 - protein, 219 aa, Artificial Sequence; identical to SEQ ID NO: 3500
  Description of Artificial Sequence: Synthetic polypeptide
  XENP021190 3H3_H2_L1.1_IgG1_PVA_/S267K Light Chain

SEQ ID NO: 3521 - protein, 112 aa, Artificial Sequence; identical to SEQ ID NO: 3501
  Description of Artificial Sequence: Synthetic polypeptide
  VL of XENP021190

SEQ ID NO: 3522 - protein, 17 aa, Artificial Sequence
  Description of Artificial Sequence: Synthetic peptide
  XENP021190 vlCDR1
RSSQSLLNSRTRKNYLA

SEQ ID NO: 3523 - protein, 7 aa, Artificial Sequence
  Description of Artificial Sequence: Synthetic peptide
  XENP021190 vlCDR2
WASTRES

SEQ ID NO: 3524 - protein, 8 aa, Artificial Sequence
  Description of Artificial Sequence: Synthetic peptide
  XENP021190 vlCDR3
KQSYSLRT

SEQ ID NO: 3525 - protein, 446 aa, Artificial Sequence; identical to SEQ ID NO: 3385
  Description of Artificial Sequence: Synthetic polypeptide
  XENP021191 3H3_H2_L2.1_IgG1_PVA_/S267K Heavy Chain

SEQ ID NO: 3526 - protein, 117 aa, Artificial Sequence; identical to SEQ ID NO: 3386
  Description of Artificial Sequence: Synthetic polypeptide
  VH of XENP021191

SEQ ID NO: 3527 - protein, 5 aa, Artificial Sequence
  Description of Artificial Sequence: Synthetic peptide
  XENP021191 vhCDR1
GYGVN

SEQ ID NO: 3528 - protein, 16 aa, Artificial Sequence
  Description of Artificial Sequence: Synthetic peptide
  XENP021191 vhCDR2
MIWGDGSTDYNSALKS

SEQ ID NO: 3529 - protein, 9 aa, Artificial Sequence
  Description of Artificial Sequence: Synthetic peptide
  XENP021191 vhCDR3
SYYTSDFDY

SEQ ID NO: 3530 - protein, 219 aa, Artificial Sequence; identical to SEQ ID NO: 3510
  Description of Artificial Sequence: Synthetic polypeptide
  XENP021191 3H3_H2_L2.1_IgG1_PVA_/S267K Light Chain

SEQ ID NO: 3531 - protein, 112 aa, Artificial Sequence; identical to SEQ ID NO: 3511
  Description of Artificial Sequence: Synthetic polypeptide
  VL of XENP021191

SEQ ID NO: 3532 - protein, 17 aa, Artificial Sequence
  Description of Artificial Sequence: Synthetic peptide
  XENP021191 vlCDR1
KSSQSLLNSRTRKNYLA

SEQ ID NO: 3533 - protein, 7 aa, Artificial Sequence
  Description of Artificial Sequence: Synthetic peptide
  XENP021191 vlCDR2
WASTRES

SEQ ID NO: 3534 - protein, 8 aa, Artificial Sequence
  Description of Artificial Sequence: Synthetic peptide
  XENP021191 vlCDR3
KQSYSLRT

SEQ ID NO: 3535 - protein, 446 aa, Artificial Sequence; identical to SEQ ID NO: 3405
  Description of Artificial Sequence: Synthetic polypeptide
  XENP021192 3H3_H3_L1.1_IgG1_PVA_/S267K Heavy Chain

SEQ ID NO: 3536 - protein, 117 aa, Artificial Sequence; identical to SEQ ID NO: 3406
  Description of Artificial Sequence: Synthetic polypeptide
  VH of XENP021192

SEQ ID NO: 3537 - protein, 5 aa, Artificial Sequence
  Description of Artificial Sequence: Synthetic peptide
  XENP021192 vhCDR1
GYGVN

SEQ ID NO: 3538 - protein, 16 aa, Artificial Sequence
  Description of Artificial Sequence: Synthetic peptide
  XENP021192 vhCDR2
MIWGDGSTDYNSAVKG

SEQ ID NO: 3539 - protein, 9 aa, Artificial Sequence
  Description of Artificial Sequence: Synthetic peptide
  XENP021192 vhCDR3
SYYTSDEDY

SEQ ID NO: 3540 - protein, 219 aa, Artificial Sequence; identical to SEQ ID NO: 3500
  Description of Artificial Sequence: Synthetic polypeptide
  XENP021192 3H3_H3_L1.1_IgG1_PVA_/S267K Light Chain

SEQ ID NO: 3541 - protein, 112 aa, Artificial Sequence; identical to SEQ ID NO: 3501
  Description of Artificial Sequence: Synthetic polypeptide
  VL of XENP021192

SEQ ID NO: 3542 - protein, 17 aa, Artificial Sequence
  Description of Artificial Sequence: Synthetic peptide
  XENP021192 vlCDR1
RSSQSLLNSRTRKNYLA

SEQ ID NO: 3543 - protein, 7 aa, Artificial Sequence
  Description of Artificial Sequence: Synthetic peptide
  XENP021192 vlCDR2
WASTRES

SEQ ID NO: 3544 - protein, 8 aa, Artificial Sequence
  Description of Artificial Sequence: Synthetic peptide
  XENP021192 vlCDR3
KQSYSLRT

SEQ ID NO: 3545 - protein, 446 aa, Artificial Sequence; identical to SEQ ID NO: 3405
  Description of Artificial Sequence: Synthetic polypeptide
  XENP021193 3H3_H3_L2.1_IgG1_PVA_/S267K Heavy Chain

SEQ ID NO: 3546 - protein, 117 aa, Artificial Sequence; identical to SEQ ID NO: 3406
  Description of Artificial Sequence: Synthetic polypeptide
  VH of XENP021193

SEQ ID NO: 3547 - protein, 5 aa, Artificial Sequence
  Description of Artificial Sequence: Synthetic peptide
  XENP021193 vhCDR1
GYGVN

SEQ ID NO: 3548 - protein, 16 aa, Artificial Sequence
  Description of Artificial Sequence: Synthetic peptide
  XENP021193 vhCDR2
MIWGDGSTDYNSAVKG

SEQ ID NO: 3549 - protein, 9 aa, Artificial Sequence
  Description of Artificial Sequence: Synthetic peptide
  XENP021193 vhCDR3
SYYTSDEDY

SEQ ID NO: 3550 - protein, 219 aa, Artificial Sequence; identical to SEQ ID NO: 3510
  Description of Artificial Sequence: Synthetic polypeptide
  XENP021193 3H3_H3_L2.1_IgG1_PVA_/S267K Light Chain

SEQ ID NO: 3551 - protein, 112 aa, Artificial Sequence; identical to SEQ ID NO: 3511
  Description of Artificial Sequence: Synthetic polypeptide
  VL of XENP021193

SEQ ID NO: 3552 - protein, 17 aa, Artificial Sequence
  Description of Artificial Sequence: Synthetic peptide
  XENP021193 vlCDR1
KSSQSLLNSRTRKNYLA

SEQ ID NO: 3553 - protein, 7 aa, Artificial Sequence
  Description of Artificial Sequence: Synthetic peptide
  XENP021193 vlCDR2
WASTRES

SEQ ID NO: 3554 - protein, 8 aa, Artificial Sequence
  Description of Artificial Sequence: Synthetic peptide
  XENP021193 vlCDR3
KQSYSLRT

SEQ ID NO: 3555 - protein, 446 aa, Artificial Sequence; identical to SEQ ID NO: 3425
  Description of Artificial Sequence: Synthetic polypeptide
  XENP021194 3H3_H4_L1.1_IgG1_PVA_/S267K Heavy Chain

SEQ ID NO: 3556 - protein, 117 aa, Artificial Sequence; identical to SEQ ID NO: 3426
  Description of Artificial Sequence: Synthetic polypeptide
  VH of XENP021194

SEQ ID NO: 3557 - protein, 5 aa, Artificial Sequence
  Description of Artificial Sequence: Synthetic peptide
  XENP021194 vhCDR1
GYGVN

SEQ ID NO: 3558 - protein, 16 aa, Artificial Sequence
  Description of Artificial Sequence: Synthetic peptide
  XENP021194 vhCDR2
MIWGDGSTDYNPSLKS

SEQ ID NO: 3559 - protein, 9 aa, Artificial Sequence
  Description of Artificial Sequence: Synthetic peptide
  XENP021194 vhCDR3
SYYTSDEDY

SEQ ID NO: 3560 - protein, 219 aa, Artificial Sequence; identical to SEQ ID NO: 3500
  Description of Artificial Sequence: Synthetic polypeptide
  XENP021194 3H3_H4_L1.1_IgG1_PVA_/S267K Light Chain

SEQ ID NO: 3561 - protein, 112 aa, Artificial Sequence; identical to SEQ ID NO: 3501
  Description of Artificial Sequence: Synthetic polypeptide
  VL of XENP021194

SEQ ID NO: 3562 - protein, 17 aa, Artificial Sequence
  Description of Artificial Sequence: Synthetic peptide
  XENP021194 vlCDR1
RSSQSLLNSRTRKNYLA

SEQ ID NO: 3563 - protein, 7 aa, Artificial Sequence
  Description of Artificial Sequence: Synthetic peptide
  XENP021194 vlCDR2
WASTRES

SEQ ID NO: 3564 - protein, 8 aa, Artificial Sequence
  Description of Artificial Sequence: Synthetic peptide
  XENP021194 vlCDR3
KQSYSLRT

SEQ ID NO: 3565 - protein, 446 aa, Artificial Sequence; identical to SEQ ID NO: 3425
  Description of Artificial Sequence: Synthetic polypeptide
  XENP021195 3H3_H4_L2.1_IgG1_PVA_/S267K Heavy Chain

SEQ ID NO: 3566 - protein, 117 aa, Artificial Sequence; identical to SEQ ID NO: 3426
  Description of Artificial Sequence: Synthetic polypeptide
  VH of XENP021195

SEQ ID NO: 3567 - protein, 5 aa, Artificial Sequence
  Description of Artificial Sequence: Synthetic peptide
  XENP021195 vhCDR1
GYGVN

SEQ ID NO: 3568 - protein, 16 aa, Artificial Sequence
  Description of Artificial Sequence: Synthetic peptide
  XENP021195 vhCDR2
MIWGDGSTDYNPSLKS

SEQ ID NO: 3569 - protein, 9 aa, Artificial Sequence
  Description of Artificial Sequence: Synthetic peptide
  XENP021195 vhCDR3
SYYTSDEDY

SEQ ID NO: 3570 - protein, 219 aa, Artificial Sequence; identical to SEQ ID NO: 3510
  Description of Artificial Sequence: Synthetic polypeptide
  XENP021195 3H3_H4_L2.1_IgG1_PVA_/S267K Light Chain

SEQ ID NO: 3571 - protein, 112 aa, Artificial Sequence; identical to SEQ ID NO: 3511
  Description of Artificial Sequence: Synthetic polypeptide
  VL of XENP021195

SEQ ID NO: 3572 - protein, 17 aa, Artificial Sequence
  Description of Artificial Sequence: Synthetic peptide
  XENP021195 vlCDR1
KSSQSLLNSRTRKNYLA

SEQ ID NO: 3573 - protein, 7 aa, Artificial Sequence
  Description of Artificial Sequence: Synthetic peptide
  XENP021195 vlCDR2
WASTRES

SEQ ID NO: 3574 - protein, 8 aa, Artificial Sequence
  Description of Artificial Sequence: Synthetic peptide
  XENP021195 vlCDR3
KQSYSLRT

SEQ ID NO: 3575 - protein, 447 aa, Artificial Sequence; identical to SEQ ID NO: 3445
  Description of Artificial Sequence: Synthetic polypeptide
  XENP021196 7B11_H1_L1.1_IgG1_PVA_/S267K Heavy Chain

SEQ ID NO: 3576 - protein, 118 aa, Artificial Sequence; identical to SEQ ID NO: 3446
  Description of Artificial Sequence: Synthetic polypeptide
  VH of XENP021196

SEQ ID NO: 3577 - protein, 5 aa, Artificial Sequence
  Description of Artificial Sequence: Synthetic peptide
  XENP021196 vhCDR1
SYAVN

SEQ ID NO: 3578 - protein, 16 aa, Artificial Sequence
  Description of Artificial Sequence: Synthetic peptide
  XENP021196 vhCDR2
VIWSGGSTDYNAKFQG

SEQ ID NO: 3579 - protein, 10 aa, Artificial Sequence
  Description of Artificial Sequence: Synthetic peptide
  XENP021196 vhCDR3
LYYRYDGFDY

SEQ ID NO: 3580 - protein, 214 aa, Artificial Sequence
  Description of Artificial Sequence: Synthetic polypeptide
  XENP021196 7B11_H1_L1.1_IgG1_PVA_/S267K Light Chain
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3581 - protein, 107 aa, Artificial Sequence
  Description of Artificial Sequence: Synthetic polypeptide
  VL of XENP021196
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIK

SEQ ID NO: 3582 - protein, 11 aa, Artificial Sequence
  Description of Artificial Sequence: Synthetic peptide
  XENP021196 vlCDR1
RASQNVGTHVA

SEQ ID NO: 3583 - protein, 7 aa, Artificial Sequence
  Description of Artificial Sequence: Synthetic peptide
  XENP021196 vlCDR2
SASYRYS

SEQ ID NO: 3584 - protein, 9 aa, Artificial Sequence
  Description of Artificial Sequence: Synthetic peptide
  XENP021196 vlCDR3
QQYNSYPLT

SEQ ID NO: 3585 - protein, 447 aa, Artificial Sequence; identical to SEQ ID NO: 3445
  Description of Artificial Sequence: Synthetic polypeptide
  XENP021201 7B11_H1_L2.1_IgG1_PVA_/S267K Heavy Chain

SEQ ID NO: 3586 - protein, 118 aa, Artificial Sequence; identical to SEQ ID NO: 3446
  Description of Artificial Sequence: Synthetic polypeptide
  VH of XENP021201

SEQ ID NO: 3587 - protein, 5 aa, Artificial Sequence
  Description of Artificial Sequence: Synthetic peptide
  XENP021201 vhCDR1
SYAVN

SEQ ID NO: 3588 - protein, 16 aa, Artificial Sequence
  Description of Artificial Sequence: Synthetic peptide
  XENP021201 vhCDR2
VIWSGGSTDYNAKFQG

SEQ ID NO: 3589 - protein, 10 aa, Artificial Sequence
  Description of Artificial Sequence: Synthetic peptide
  XENP021201 vhCDR3
LYYRYDGFDY

SEQ ID NO: 3590 - protein, 214 aa, Artificial Sequence
  Description of Artificial Sequence: Synthetic polypeptide
  XENP021201 7B11_H1_L2.1_IgG1_PVA_/S267K Light Chain
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3591 - protein, 107 aa, Artificial Sequence
  Description of Artificial Sequence: Synthetic polypeptide
  VL of XENP021201
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIK

SEQ ID NO: 3592 - protein, 11 aa, Artificial Sequence
  Description of Artificial Sequence: Synthetic peptide
  XENP021201 vlCDR1
KASQNVGTHVA

SEQ ID NO: 3593 - protein, 7 aa, Artificial Sequence
  Description of Artificial Sequence: Synthetic peptide
  XENP021201 vlCDR2
SASYRYS

SEQ ID NO: 3594 - protein, 9 aa, Artificial Sequence
  Description of Artificial Sequence: Synthetic peptide
  XENP021201 vlCDR3
QQYNSYPLT

SEQ ID NO: 3595 - protein, 447 aa, Artificial Sequence
  Description of Artificial Sequence: Synthetic polypeptide
  XENP021202 7B11_H2.1_L1.1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3596 - protein, 118 aa, Artificial Sequence
  Description of Artificial Sequence: Synthetic polypeptide
  VH of XENP021202
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSS

SEQ ID NO: 3597 - protein, 5 aa, Artificial Sequence
  Description of Artificial Sequence: Synthetic peptide
  XENP021202 vhCDR1
SYAVN

SEQ ID NO: 3598 - protein, 16 aa, Artificial Sequence
  Description of Artificial Sequence: Synthetic peptide
  XENP021202 vhCDR2
VIWSGGSTDYNPSVKG

SEQ ID NO: 3599 - protein, 10 aa, Artificial Sequence
  Description of Artificial Sequence: Synthetic peptide
  XENP021202 vhCDR3
LYYRYDGFDY

SEQ ID NO: 3600 - protein, 214 aa, Artificial Sequence; identical to SEQ ID NO: 3580
  Description of Artificial Sequence: Synthetic polypeptide
  XENP021202 7B11_H2.1_L1.1_IgG1_PVA_/S267K Light Chain

SEQ ID NO: 3601 - protein, 107 aa, Artificial Sequence; identical to SEQ ID NO: 3581
  Description of Artificial Sequence: Synthetic polypeptide
  VL of XENP021202

SEQ ID NO: 3602 - protein, 11 aa, Artificial Sequence
  Description of Artificial Sequence: Synthetic peptide
  XENP021202 vlCDR1
RASQNVGTHVA

SEQ ID NO: 3603 - protein, 7 aa, Artificial Sequence
  Description of Artificial Sequence: Synthetic peptide
  XENP021202 vlCDR2
SASYRYS

SEQ ID NO: 3604 - protein, 9 aa, Artificial Sequence
  Description of Artificial Sequence: Synthetic peptide
  XENP021202 vlCDR3
QQYNSYPLT

SEQ ID NO: 3605 - protein, 447 aa, Artificial Sequence; identical to SEQ ID NO: 3595
  Description of Artificial Sequence: Synthetic polypeptide
  XENP021203 7B11_H2.1_L2.1_IgG1_PVA_/S267K Heavy Chain

SEQ ID NO: 3606 - protein, 118 aa, Artificial Sequence; identical to SEQ ID NO: 3596
  Description of Artificial Sequence: Synthetic polypeptide
  VH of XENP021203

SEQ ID NO: 3607 - protein, 5 aa, Artificial Sequence
  Description of Artificial Sequence: Synthetic peptide
  XENP021203 vhCDR1
SYAVN

SEQ ID NO: 3608 - protein, 16 aa, Artificial Sequence
  Description of Artificial Sequence: Synthetic peptide
  XENP021203 vhCDR2
VIWSGGSTDYNPSVKG

SEQ ID NO: 3609 - protein, 10 aa, Artificial Sequence
  Description of Artificial Sequence: Synthetic peptide
  XENP021203 vhCDR3
LYYRYDGFDY

SEQ ID NO: 3610 - protein, 214 aa, Artificial Sequence; identical to SEQ ID NO: 3590
  Description of Artificial Sequence: Synthetic polypeptide
  XENP021203 7B11_H2.1_L2.1_IgG1_PVA_/S267K Light Chain

SEQ ID NO: 3611 - protein, 107 aa, Artificial Sequence; identical to SEQ ID NO: 3591
  Description of Artificial Sequence: Synthetic polypeptide
  VL of XENP021203

SEQ ID NO: 3612 - protein, 11 aa, Artificial Sequence
  Description of Artificial Sequence: Synthetic peptide
  XENP021203 vlCDR1
KASQNVGTHVA

SEQ ID NO: 3613 - protein, 7 aa, Artificial Sequence
  Description of Artificial Sequence: Synthetic peptide
  XENP021203 vlCDR2
SASYRYS

SEQ ID NO: 3614 - protein, 9 aa, Artificial Sequence
  Description of Artificial Sequence: Synthetic peptide
  XENP021203 vlCDR3
QQYNSYPLT

SEQ ID NO: 3615 - protein, 446 aa, Artificial Sequence
  Description of Artificial Sequence: Synthetic polypeptide
  XENP021204 7C2_H1.1_L1.1_IgG1_PVA_/S267K Heavy Chain
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3616 - protein, 117 aa, Artificial Sequence
  Description of Artificial Sequence: Synthetic polypeptide
  VH of XENP021204
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSS

SEQ ID NO: 3617 - protein, 5 aa, Artificial Sequence
  Description of Artificial Sequence: Synthetic peptide
  XENP021204 vhCDR1
RYAMS

SEQ ID NO: 3618 - protein, 16 aa, Artificial Sequence
  Description of Artificial Sequence: Synthetic peptide
  XENP021204 vhCDR2
SISSGGSTYYPDSVKG

SEQ ID NO: 3619 - protein, 9 aa, Artificial Sequence
  Description of Artificial Sequence: Synthetic peptide
  XENP021204 vhCDR3
GDYEGYFDY

SEQ ID NO: 3620 - protein, 220 aa, Artificial Sequence
  Description of Artificial Sequence: Synthetic polypeptide
  XENP021204 7C2_H1.1_L1.1_IgG1_PVA_/S267K Light Chain
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3621 - protein, 113 aa, Artificial Sequence
  Description of Artificial Sequence: Synthetic polypeptide
  VL of XENP021204
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIK

SEQ ID NO: 3622 - protein, 17 aa, Artificial Sequence
  Description of Artificial Sequence: Synthetic peptide
  XENP021204 vlCDR1
KSSQSLLNSINQKNYLA

SEQ ID NO: 3623 - protein, 7 aa, Artificial Sequence
  Description of Artificial Sequence: Synthetic peptide
  XENP021204 vlCDR2
FASTRES

SEQ ID NO: 3624 - protein, 9 aa, Artificial Sequence
  Description of Artificial Sequence: Synthetic peptide
  XENP021204 vlCDR3
QQHYSTPLT

SEQ ID NO: 3625 - protein, 442 aa, Artificial Sequence
  Description of Artificial Sequence: Synthetic polypeptide
  XENP021492 1D12_H0L0_IgG1_PVA_/S267K Heavy Chain
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3626 - protein, 113 aa, Artificial Sequence
  Description of Artificial Sequence: Synthetic polypeptide
  VH of XENP021492
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSA

SEQ ID NO: 3627 - protein, 5 aa, Artificial Sequence
  Description of Artificial Sequence: Synthetic peptide
  XENP021492 vhCDR1
SFDMS

SEQ ID NO: 3628 - protein, 17 aa, Artificial Sequence
  Description of Artificial Sequence: Synthetic peptide
  XENP021492 vhCDR2
YISSDGASTFYPDTMKG

SEQ ID NO: 3629 - protein, 4 aa, Artificial Sequence
  Description of Artificial Sequence: Synthetic peptide
  XENP021492 vhCDR3
LGAY

SEQ ID NO: 3630 - protein, 218 aa, Artificial Sequence
  Description of Artificial Sequence: Synthetic polypeptide
  XENP021492 1D12_H0L0_IgG1_PVA_/S267K Light Chain
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3631 - protein, 111 aa, Artificial Sequence
  Description of Artificial Sequence: Synthetic polypeptide
  VL of XENP021492
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIK

SEQ ID NO: 3632 - protein, 15 aa, Artificial Sequence
  Description of Artificial Sequence: Synthetic peptide
  XENP021492 vlCDR1
RASESVEYYGTSLMQ

SEQ ID NO: 3633 - protein, 7 aa, Artificial Sequence
  Description of Artificial Sequence: Synthetic peptide
  XENP021492 vlCDR2
AASNVES

SEQ ID NO: 3634 - protein, 9 aa, Artificial Sequence
  Description of Artificial Sequence: Synthetic peptide
  XENP021492 vlCDR3
QQSRKVPWT

SEQ ID NO: 3635 - protein, 446 aa, Artificial Sequence
  Description of Artificial Sequence: Synthetic polypeptide
  XENP021493 6C8_H0L0_IgG1_PVA_/S267K Heavy Chain
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3636 - protein, 117 aa, Artificial Sequence
  Description of Artificial Sequence: Synthetic polypeptide
  VH of XENP021493
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSA

SEQ ID NO: 3637 - protein, 5 aa, Artificial Sequence
  Description of Artificial Sequence: Synthetic peptide
  XENP021493 vhCDR1
GYGVN

SEQ ID NO: 3638 - protein, 16 aa, Artificial Sequence
  Description of Artificial Sequence: Synthetic peptide
  XENP021493 vhCDR2
MIWGDGSTDYNSALKS

SEQ ID NO: 3639 - protein, 9 aa, Artificial Sequence
  Description of Artificial Sequence: Synthetic peptide
  XENP021493 vhCDR3
SYYTSDEDY

SEQ ID NO: 3640 - protein, 214 aa, Artificial Sequence
  Description of Artificial Sequence: Synthetic polypeptide
  XENP021493 6C8_H0L0_IgG1_PVA_/S267K Light Chain
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3641 - protein, 107 aa, Artificial Sequence
  Description of Artificial Sequence: Synthetic polypeptide
  VL of XENP021493
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIK

SEQ ID NO: 3642 - protein, 11 aa, Artificial Sequence
  Description of Artificial Sequence: Synthetic peptide
  XENP021493 vlCDR1
KASQNVGSNVA

SEQ ID NO: 3643 - protein, 7 aa, Artificial Sequence
  Description of Artificial Sequence: Synthetic peptide
  XENP021493 vlCDR2
SASFRYS

SEQ ID NO: 3644 - protein, 9 aa, Artificial Sequence
  Description of Artificial Sequence: Synthetic peptide
  XENP021493 vlCDR3
QQYNSYPYT

SEQ ID NO: 3645 - protein, 446 aa, Artificial Sequence
  Description of Artificial Sequence: Synthetic polypeptide
  XENP021494 6D9_H0_1D12_L0_IgG1_PVA_/S267K Heavy Chain
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3646 - protein, 117 aa, Artificial Sequence
  Description of Artificial Sequence: Synthetic polypeptide
  VH of XENP021494
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSS

SEQ ID NO: 3647 - protein, 5 aa, Artificial Sequence
  Description of Artificial Sequence: Synthetic peptide
  XENP021494 vhCDR1
SYGVH

SEQ ID NO: 3648 - protein, 16 aa, Artificial Sequence
  Description of Artificial Sequence: Synthetic peptide
  XENP021494 vhCDR2
VIWSGGSTEYNAAFIS

SEQ ID NO: 3649 - protein, 9 aa, Artificial Sequence
  Description of Artificial Sequence: Synthetic peptide
  XENP021494 vhCDR3
GGLLSPFDY

SEQ ID NO: 3650 - protein, 218 aa, Artificial Sequence; identical to SEQ ID NO: 3630
  Description of Artificial Sequence: Synthetic polypeptide
  XENP021494 6D9_H0_1D12_L0_IgG1_PVA_/S267K Light Chain

SEQ ID NO: 3651 - protein, 111 aa, Artificial Sequence; identical to SEQ ID NO: 3631
  Description of Artificial Sequence: Synthetic polypeptide
  VL of XENP021494

SEQ ID NO: 3652 - protein, 15 aa, Artificial Sequence
  Description of Artificial Sequence: Synthetic peptide
  XENP021494 vlCDR1
RASESVEYYGTSLMQ

SEQ ID NO: 3653 - protein, 7 aa, Artificial Sequence
  Description of Artificial Sequence: Synthetic peptide
  XENP021494 vlCDR2
AASNVES

SEQ ID NO: 3654 - protein, 9 aa, Artificial Sequence
  Description of Artificial Sequence: Synthetic peptide
  XENP021494 vlCDR3
QQSRKVPWT

SEQ ID NO: 3655 - protein, 452 aa, Artificial Sequence
  Description of Artificial Sequence: Synthetic polypeptide
  XENP021495 7A9_H0L0_IgG1_PVA_/S267K Heavy Chain
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3656 - protein, 123 aa, Artificial Sequence
  Description of Artificial Sequence: Synthetic polypeptide
  VH of XENP021495
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSA

SEQ ID NO: 3657 - protein, 5 aa, Artificial Sequence
  Description of Artificial Sequence: Synthetic peptide
  XENP021495 vhCDR1
RYWMS

SEQ ID NO: 3658 - protein, 17 aa, Artificial Sequence
  Description of Artificial Sequence: Synthetic peptide
  XENP021495 vhCDR2
EINPDSSTINYTPSLKD

SEQ ID NO: 3659 - protein, 14 aa, Artificial Sequence
  Description of Artificial Sequence: Synthetic peptide
  XENP021495 vhCDR3
PNGYYVGTIFPFAY

SEQ ID NO: 3660 - protein, 215 aa, Artificial Sequence
  Description of Artificial Sequence: Synthetic polypeptide
  XENP021495 7A9_H0L0_IgG1_PVA_/S267K Light Chain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3661 - protein, 215 aa, Artificial Sequence; identical to SEQ ID NO: 3660
  Description of Artificial Sequence: Synthetic polypeptide
  VL of XENP021495

SEQ ID NO: 3662 - protein, 14 aa, Artificial Sequence
  Description of Artificial Sequence: Synthetic peptide
  XENP021495 vlCDR1
RSSTGAVTTSNYAN

SEQ ID NO: 3663 - protein, 7 aa, Artificial Sequence
  Description of Artificial Sequence: Synthetic peptide
  XENP021495 vlCDR2
GTNNRAP

SEQ ID NO: 3664 - protein, 9 aa, Artificial Sequence
  Description of Artificial Sequence: Synthetic peptide
  XENP021495 vlCDR3
ALWYSNHWV

SEQ ID NO: 3665 - protein, 447 aa, Artificial Sequence
  Description of Artificial Sequence: Synthetic polypeptide
  XENP021496 7B11_H0L0_IgG1_PVA_/S267K Heavy Chain
QVQLKQSGPGLVQPSQSLSITCTVSGFSLTSYAVNWVRQSPGKGLEWLGVIWSGGSTDYNAAFISRLSISKDNSKSQVFFKMNSLQANDTAIYYCVSLYYRYDGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3666 - protein, 118 aa, Artificial Sequence
  Description of Artificial Sequence: Synthetic polypeptide
  VH of XENP021496
QVQLKQSGPGLVQPSQSLSITCTVSGFSLTSYAVNWVRQSPGKGLEWLGVIWSGGSTDYNAAFISRLSISKDNSKSQVFFKMNSLQANDTAIYYCVSLYYRYDGFDYWGQGTLVTVSA

SEQ ID NO: 3667 - protein, 5 aa, Artificial Sequence
  Description of Artificial Sequence: Synthetic peptide
  XENP021496 vhCDR1
SYAVN

SEQ ID NO: 3668 - protein, 16 aa, Artificial Sequence
  Description of Artificial Sequence: Synthetic peptide
  XENP021496 vhCDR2
VIWSGGSTDYNAAFIS

SEQ ID NO: 3669 - protein, 10 aa, Artificial Sequence
  Description of Artificial Sequence: Synthetic peptide
  XENP021496 vhCDR3
LYYRYDGFDY

SEQ ID NO: 3670 - protein, 214 aa, Artificial Sequence
  Description of Artificial Sequence: Synthetic polypeptide
  XENP021496 7B11_H0L0_IgG1_PVA_/S267K Light Chain
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3671 - protein, 107 aa, Artificial Sequence
  Description of Artificial Sequence: Synthetic polypeptide
  VL of XENP021496
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIK

SEQ ID NO: 3672 - protein, 11 aa, Artificial Sequence
  Description of Artificial Sequence: Synthetic peptide
  XENP021496 vlCDR1
KASQNVGTHVA

SEQ ID NO: 3673 - protein, 7 aa, Artificial Sequence
  Description of Artificial Sequence: Synthetic peptide
  XENP021496 vlCDR2
SASYRYS

SEQ ID NO: 3674 - protein, 9 aa, Artificial Sequence
  Description of Artificial Sequence: Synthetic peptide
  XENP021496 vlCDR3
QQYNSYPLT

SEQ ID NO: 3675 - protein, 447 aa, Artificial Sequence
  Description of Artificial Sequence: Synthetic polypeptide
  XENP021501 7B11var_H0L0_IgG1_PVA_/S267K Heavy Chain
QVQLKQSGPGLVQPSQSLSITCTVSGFSLTSYAVNWVRQSPGKGLEWLGVIWSGGSTDYNAAFISRLSISKDNSKSQVFFKMNSLQADDTAIYYCVSLYYRYDGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3676 - protein, 118 aa, Artificial Sequence
  Description of Artificial Sequence: Synthetic polypeptide
  VH of XENP021501
QVQLKQSGPGLVQPSQSLSITCTVSGFSLTSYAVNWVRQSPGKGLEWLGVIWSGGSTDYNAAFISRLSISKDNSKSQVFFKMNSLQADDTAIYYCVSLYYRYDGFDYWGQGTLVTVSA

SEQ ID NO: 3677 - protein, 5 aa, Artificial Sequence
  Description of Artificial Sequence: Synthetic peptide
  XENP021501 vhCDR1
SYAVN

SEQ ID NO: 3678 - protein, 16 aa, Artificial Sequence
  Description of Artificial Sequence: Synthetic peptide
  XENP021501 vhCDR2
VIWSGGSTDYNAAFIS

SEQ ID NO: 3679 - protein, 10 aa, Artificial Sequence
  Description of Artificial Sequence: Synthetic peptide
  XENP021501 vhCDR3
LYYRYDGFDY

SEQ ID NO: 3680 - protein, 214 aa, Artificial Sequence; identical to SEQ ID NO: 3670
  Description of Artificial Sequence: Synthetic polypeptide
  XENP021501 7B11var_H0L0_IgG1_PVA_/S267K Light Chain

SEQ ID NO: 3681 - protein, 107 aa, Artificial Sequence; identical to SEQ ID NO: 3671
  Description of Artificial Sequence: Synthetic polypeptide
  VL of XENP021501

SEQ ID NO: 3682 - protein, 11 aa, Artificial Sequence
  Description of Artificial Sequence: Synthetic peptide
  XENP021501 vlCDR1
KASQNVGTHVA

SEQ ID NO: 3683 - protein, 7 aa, Artificial Sequence
  Description of Artificial Sequence: Synthetic peptide
  XENP021501 vlCDR2
SASYRYS

SEQ ID NO: 3684 - protein, 9 aa, Artificial Sequence
  Description of Artificial Sequence: Synthetic peptide
  XENP021501 vlCDR3
QQYNSYPLT

SEQ ID NO: 3685 - protein, 446 aa, Artificial Sequence
  Description of Artificial Sequence: Synthetic polypeptide
  XENP021502 7C2_H0L0_IgG1_PVA_/S267K Heavy Chain
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3686 - protein, 117 aa, Artificial Sequence
  Description of Artificial Sequence: Synthetic polypeptide
  VH of XENP021502
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSS

SEQ ID NO: 3687 - protein, 5 aa, Artificial Sequence
  Description of Artificial Sequence: Synthetic peptide
  XENP021502 vhCDR1
RYAMS

SEQ ID NO: 3688 - protein, 16 aa, Artificial Sequence
  Description of Artificial Sequence: Synthetic peptide
  XENP021502 vhCDR2
SISSGGSTYYPDSVQG

SEQ ID NO: 3689 - protein, 9 aa, Artificial Sequence
  Description of Artificial Sequence: Synthetic peptide
  XENP021502 vhCDR3
GDYEGYFDY

SEQ ID NO: 3690 - protein, 220 aa, Artificial Sequence
  Description of Artificial Sequence: Synthetic polypeptide
  XENP021502 7C2_H0L0_IgG1_PVA_/S267K Light Chain
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3691 - protein, 113 aa, Artificial Sequence
  Description of Artificial Sequence: Synthetic polypeptide
  VL of XENP021502
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELK

SEQ ID NO: 3692 - protein, 17 aa, Artificial Sequence
  Description of Artificial Sequence: Synthetic peptide
  XENP021502 vlCDR1
KSSQSLLNSINQKNYLA

SEQ ID NO: 3693 - protein, 7 aa, Artificial Sequence
  Description of Artificial Sequence: Synthetic peptide
  XENP021502 vlCDR2
FASTRES

SEQ ID NO: 3694 - protein, 9 aa, Artificial Sequence
  Description of Artificial Sequence: Synthetic peptide
  XENP021502 vlCDR3
QQHYSTPLT

SEQ ID NO: 3695 - protein, 442 aa, Artificial Sequence; identical to SEQ ID NO: 3625
  Description of Artificial Sequence: Synthetic polypeptide
  XENP021503 1D10_H0L0_IgG1_PVA_/S267K Heavy Chain

SEQ ID NO: 3696 - protein, 113 aa, Artificial Sequence; identical to SEQ ID NO: 3626
  Description of Artificial Sequence: Synthetic polypeptide
  VH of XENP021503

SEQ ID NO: 3697 - protein, 5 aa, Artificial Sequence
  Description of Artificial Sequence: Synthetic peptide
  XENP021503 vhCDR1
SFDMS

SEQ ID NO: 3698 - protein, 17 aa, Artificial Sequence
  Description of Artificial Sequence: Synthetic peptide
  XENP021503 vhCDR2
YISSDGASTFYPDTMKG

SEQ ID NO: 3699 - protein, 4 aa, Artificial Sequence
  Description of Artificial Sequence: Synthetic peptide
  XENP021503 vhCDR3
LGAY

SEQ ID NO: 3700 - protein, 219 aa, Artificial Sequence
  Description of Artificial Sequence: Synthetic polypeptide
  XENP021503 1D10_H0L0_IgG1_PVA_/S267K Light Chain
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3701 - protein, 112 aa, Artificial Sequence
  Description of Artificial Sequence: Synthetic polypeptide
  VL of XENP021503
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 3702 - protein, 16 aa, Artificial Sequence
  Description of Artificial Sequence: Synthetic peptide
  XENP021503 vlCDR1
KSSQSLLDSDGKTYLN

SEQ ID NO: 3703 - protein, 7 aa, Artificial Sequence
  Description of Artificial Sequence: Synthetic peptide
  XENP021503 vlCDR2
LVSKLDS

SEQ ID NO: 3704 - protein, 9 aa, Artificial Sequence
  Description of Artificial Sequence: Synthetic peptide
  XENP021503 vlCDR3
WQGTHFPYT

SEQ ID NO: 3705 - protein, 120 aa, Artificial Sequence
  Description of Artificial Sequence: Synthetic polypeptide
  3C2[BTLA] variable heavy Chain
QVQLQESGPGLVKPSETLSLTCTISGGSISNYYWNWIRQPPGKGLEWIGYIYYSTSTKYNPSLKSRVTMSVETSKNQFSLKLSSVTAADTAVYYCARVKVYSTGWFFDYWGQGTLVTVSS

SEQ ID NO: 3706 - protein, 5 aa, Artificial Sequence
  Description of Artificial Sequence: Synthetic peptide
  3C2[BTLA] vhCDR1
NYYWN

SEQ ID NO: 3707 - protein, 16 aa, Artificial Sequence
  Description of Artificial Sequence: Synthetic peptide
  3C2[BTLA] vhCDR2
YIYYSTSTKYNPSLKS

SEQ ID NO: 3708 - protein, 12 aa, Artificial Sequence
  Description of Artificial Sequence: Synthetic peptide
  3C2[BTLA] vhCDR3
VKVYSTGWFFDY

SEQ ID NO: 3709 - protein, 107 aa, Artificial Sequence [sequence omitted]

SEQ ID NO: 3710 - protein, 11 aa, Artificial Sequence
  Description of Artificial Sequence: Synthetic peptide
  3C2[BTLA] vlCDR1
RASQGISSALA

SEQ ID NO: 3711 - protein, 7 aa, Artificial Sequence
  Description of Artificial Sequence: Synthetic peptide
  3C2[BTLA] vlCDR2
DASSLES

SEQ ID NO: 3712 - protein, 9 aa, Artificial Sequence
  Description of Artificial Sequence: Synthetic peptide
  3C2[BTLA] vlCDR3
QQFNSYPLT

SEQ ID NO: 3713 - protein, 127 aa, Artificial Sequence
  Description of Artificial Sequence: Synthetic polypeptide
  11E2[BTLA] variable heavy Chain
EVQLVESGGGVIRPGGSLRLSCAASGFTFDDYGMSWVRQAPGKGLEWVSGINWNGGSTGYAASVKGRFTISRDNAKNSLYLQMNSLRAEDSALYYCARDYYYGPGSPNYFYYAMDVWGQGTTVTVSS

SEQ ID NO: 3714 - protein, 5 aa, Artificial Sequence
  Description of Artificial Sequence: Synthetic peptide
  11E2[BTLA] vhCDR1
DYGMS

SEQ ID NO: 3715 - protein, 17 aa, Artificial Sequence
  Description of Artificial Sequence: Synthetic peptide
  11E2[BTLA] vhCDR2
GINWNGGSTGYAASVKG

SEQ ID NO: 3716 - protein, 18 aa, Artificial Sequence
  Description of Artificial Sequence: Synthetic peptide
  11E2[BTLA] vhCDR3
DYYYGPGSPNYFYYAMDV

SEQ ID NO: 3717 - protein, 107 aa, Artificial Sequence
  Description of Artificial Sequence: Synthetic polypeptide
  11E2[BTLA] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 3718 - protein, 11 aa, Artificial Sequence
  Description of Artificial Sequence: Synthetic peptide
  11E2[BTLA] vlCDR1
RASQGISSWLA

SEQ ID NO: 3719 - protein, 7 aa, Artificial Sequence
  Description of Artificial Sequence: Synthetic peptide
  11E2[BTLA] vlCDR2
AASSLQS

SEQ ID NO: 3720 - protein, 9 aa, Artificial Sequence
  Description of Artificial Sequence: Synthetic peptide
  11E2[BTLA] vlCDR3
QQYNSYPRT

SEQ ID NO: 3721 - protein, 119 aa, Artificial Sequence
  Description of Artificial Sequence: Synthetic polypeptide
  4C7[BTLA] variable heavy Chain
QVQLQESGPGLVKPSETLSLTCTVHGGSINHYYWSWIRQPPGKGLEWIGYIYYSGSTKYNPSLKSRVSISVDTSKNQFSLKLTSVTAADTAVYYCAREWPYYYYEMDVWGQGTTVTVSS

SEQ ID NO: 3722 - protein, 5 aa, Artificial Sequence
  Description of Artificial Sequence: Synthetic peptide
  4C7[BTLA] vhCDR1
HYYWS

SEQ ID NO: 3723 - protein, 16 aa, Artificial Sequence
  Description of Artificial Sequence: Synthetic peptide
  4C7[BTLA] vhCDR2
YIYYSGSTKYNPSLKS

SEQ ID NO: 3724 - protein, 11 aa, Artificial Sequence
  Description of Artificial Sequence: Synthetic peptide
  4C7[BTLA] vhCDR3
EWPYYYYEMDV

SEQ ID NO: 3725 - protein, 108 aa, Artificial Sequence
  Description of Artificial Sequence: Synthetic polypeptide
  4C7[BTLA] variable light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFRTFGQGTKVEIK

SEQ ID NO: 3726 - protein, 12 aa, Artificial Sequence
  Description of Artificial Sequence: Synthetic peptide
  4C7[BTLA] vlCDR1
RASQSVSSSYLA

SEQ ID NO: 3727 - protein, 7 aa, Artificial Sequence
  Description of Artificial Sequence: Synthetic peptide
  4C7[BTLA] vlCDR2
GASSRAT

SEQ ID NO: 3728 - protein, 9 aa, Artificial Sequence
  Description of Artificial Sequence: Synthetic peptide
  4C7[BTLA] vlCDR3
QQYGSSFRT

SEQ ID NO: 3729 - protein, 121 aa, Artificial Sequence
  Description of Artificial Sequence: Synthetic polypeptide
  8D5[BTLA] variable heavy Chain
EVQLVESGGGLVQPGGSLRLSCAASGFTISSYDMHWVRQATGKGLEWVSVIGPAGDTYYPGSVKGRFTISRENAKNSLYLQMNSLRAGDTAVYYCAREGMAAHNYYGMDVWGQGTTVTVSS

SEQ ID NO: 3730 - protein, 5 aa, Artificial Sequence
  Description of Artificial Sequence: Synthetic peptide
  8D5[BTLA] vhCDR1
SYDMH

SEQ ID NO: 3731 - protein, 16 aa, Artificial Sequence
  Description of Artificial Sequence: Synthetic peptide
  8D5[BTLA] vhCDR2
VIGPAGDTYYPGSVKG

SEQ ID NO: 3732 - protein, 13 aa, Artificial Sequence
  Description of Artificial Sequence: Synthetic peptide
  8D5[BTLA] vhCDR3
EGMAAHNYYGMDV

SEQ ID NO: 3733 - protein, 108 aa, Artificial Sequence
  Description of Artificial Sequence: Synthetic polypeptide
  8D5[BTLA] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPITFGQGTRLEIK

SEQ ID NO: 3734 - protein, 11 aa, Artificial Sequence
  Description of Artificial Sequence: Synthetic peptide
  8D5[BTLA] vlCDR1
RASQSVSSYLA

SEQ ID NO: 3735 - protein, 7 aa, Artificial Sequence
  Description of Artificial Sequence: Synthetic peptide
  8D5[BTLA] vlCDR2
DASNRAT

SEQ ID NO: 3736 - protein, 10 aa, Artificial Sequence
  Description of Artificial Sequence: Synthetic peptide
  8D5[BTLA] vlCDR3
QQRSNWPPIT

SEQ ID NO: 3737 - protein, 118 aa, Artificial Sequence
  Description of Artificial Sequence: Synthetic polypeptide
  ipilimumab[CTLA-4] variable heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 3738 - protein, 5 aa, Artificial Sequence
  Description of Artificial Sequence: Synthetic peptide
  ipilimumab[CTLA-4] vhCDR1
SYTMH

SEQ ID NO: 3739 - protein, 17 aa, Artificial Sequence
  Description of Artificial Sequence: Synthetic peptide
  ipilimumab[CTLA-4] vhCDR2
FISYDGNNKYYADSVKG

SEQ ID NO: 3740 - protein, 9 aa, Artificial Sequence
  Description of Artificial Sequence: Synthetic peptide
  ipilimumab[CTLA-4] vhCDR3
TGWLGPFDY

SEQ ID NO: 3741 - protein, 108 aa, Artificial Sequence
  Description of Artificial Sequence: Synthetic polypeptide
  ipilimumab[CTLA-4] variable light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 3742 - protein, 12 aa, Artificial Sequence
  Description of Artificial Sequence: Synthetic peptide
  ipilimumab[CTLA-4] vlCDR1
RASQSVGSSYLA

SEQ ID NO: 3743 - protein, 7 aa, Artificial Sequence
  Description of Artificial Sequence: Synthetic peptide
  ipilimumab[CTLA-4] vlCDR2
GAFSRAT

SEQ ID NO: 3744 - protein, 9 aa, Artificial Sequence
  Description of Artificial Sequence: Synthetic peptide
  ipilimumab[CTLA-4] vlCDR3
QQYGSSPWT

SEQ ID NO: 3745 - protein, 125 aa, Artificial Sequence
  Description of Artificial Sequence: Synthetic polypeptide
  tremelimumab[CTLA-4] variable heavy Chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 3746 - protein, 5 aa, Artificial Sequence
  Description of Artificial Sequence: Synthetic peptide
  tremelimumab[CTLA-4] vhCDR1
SYGMH

SEQ ID NO: 3747 - protein, 17 aa, Artificial Sequence
  Description of Artificial Sequence: Synthetic peptide
  tremelimumab[CTLA-4] vhCDR2
VIWYDGSNKYYADSVKG

SEQ ID NO: 3748 - protein, 16 aa, Artificial Sequence
  Description of Artificial Sequence: Synthetic peptide
  tremelimumab[CTLA-4] vhCDR3
DPRGATLYYYYYGMDV

SEQ ID NO: 3749 - protein, 107 aa, Artificial Sequence
  Description of Artificial Sequence: Synthetic polypeptide
  tremelimumab[CTLA-4] variable light Chain
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 3750 - protein, 11 aa, Artificial Sequence
  Description of Artificial Sequence: Synthetic peptide
  tremelimumab[CTLA-4] vlCDR1
RASQSINSYLD

SEQ ID NO: 3751 - protein, 7 aa, Artificial Sequence
  Description of Artificial Sequence: Synthetic peptide
  tremelimumab[CTLA-4] vlCDR2
AASSLQS

SEQ ID NO: 3752 - protein, 9 aa, Artificial Sequence
  Description of Artificial Sequence: Synthetic peptide
  tremelimumab[CTLA-4] vlCDR3
QQYYSTPFT

SEQ ID NO: 3753 - protein, 118 aa, Artificial Sequence
  Description of Artificial Sequence: Synthetic polypeptide
  AGEN1884[CTLA-4] variable heavy Chain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVGLMGPFDIWGQGTMVTVSS

SEQ ID NO: 3754 - protein, 5 aa, Artificial Sequence
  Description of Artificial Sequence: Synthetic peptide
  AGEN1884[CTLA-4] vhCDR1
SYSMN

SEQ ID NO: 3755 - protein, 17 aa, Artificial Sequence
  Description of Artificial Sequence: Synthetic peptide
  AGEN1884[CTLA-4] vhCDR2
SISSSSSYIYYADSVKG

SEQ ID NO: 3756 - protein, 9 aa, Artificial Sequence
  Description of Artificial Sequence: Synthetic peptide
  AGEN1884[CTLA-4] vhCDR3
VGLMGPFDI

SEQ ID NO: 3757 - protein, 107 aa, Artificial Sequence
  Description of Artificial Sequence: Synthetic polypeptide
  AGEN1884[CTLA-4] variable light Chain
EIVLTQSPGTLSLSPGERATLSCRASQSVSRYLGWYQQKPGQAPRLLIYGASTRATGIPDRFSGSGSGTDFTLTITRLEPEDFAVYYCQQYGSSPWTFGQGTKVEIK

SEQ ID NO: 3758 - protein, 11 aa, Artificial Sequence
  Description of Artificial Sequence: Synthetic peptide
  AGEN1884[CTLA-4] vlCDR1
RASQSVSRYLG

SEQ ID NO: 3759 - protein, 7 aa, Artificial Sequence
  Description of Artificial Sequence: Synthetic peptide
  AGEN1884[CTLA-4] vlCDR2
GASTRAT

SEQ ID NO: 3760 - protein, 9 aa, Artificial Sequence
  Description of Artificial Sequence: Synthetic peptide
  AGEN1884[CTLA-4] vlCDR3
QQYGSSPWT

SEQ ID NO: 3761 - protein, 116 aa, Artificial Sequence
  Description of Artificial Sequence: Synthetic polypeptide
  4.3F6B5[CTLA-4] variable heavy Chain
EVQLQPSGPVLVKPGASVKISCKASGYTFTDYKIHWVKQSHGKSLEWIGYIYPYSGSSDYNQKFKSKATLTVDNSSTTAYMELRSLTSEDSAVYYCARGGDAMDYWGQGTAVTVSS

SEQ ID NO: 3762 - protein, 5 aa, Artificial Sequence
  Description of Artificial Sequence: Synthetic peptide
  4.3F6B5[CTLA-4] vhCDR1
DYKIH

SEQ ID NO: 3763 - protein, 17 aa, Artificial Sequence
  Description of Artificial Sequence: Synthetic peptide
  4.3F6B5[CTLA-4] vhCDR2
YIYPYSGSSDYNQKFKS

SEQ ID NO: 3764 - protein, 7 aa, Artificial Sequence
  Description of Artificial Sequence: Synthetic peptide
  4.3F6B5[CTLA-4] vhCDR3
GGDAMDY

SEQ ID NO: 3765 - protein, 106 aa, Artificial Sequence
  Description of Artificial Sequence: Synthetic polypeptide
  4.3F6B5[CTLA-4] variable light Chain
DILMTQSPASLSASVGETVTITCGASENIYGALNWYQRKQGKSPQLLIYGATNLADGMSSRFSGSGLGRQYYLKISSLHPDDVATYFCQNILGTWTFGGGTKLEIK

SEQ ID NO: 3766 - protein, 11 aa, Artificial Sequence
  Description of Artificial Sequence: Synthetic peptide
  4.3F6B5[CTLA-4] vlCDR1
GASENIYGALN

SEQ ID NO: 3767 - protein, 7 aa, Artificial Sequence
  Description of Artificial Sequence: Synthetic peptide
  4.3F6B5[CTLA-4] vlCDR2
GATNLAD

SEQ ID NO: 3768 - protein, 8 aa, Artificial Sequence
  Description of Artificial Sequence: Synthetic peptide
  4.3F6B5[CTLA-4] vlCDR3
QNILGTWT

SEQ ID NO: 3769 - protein, 117 aa, Artificial Sequence
  Description of Artificial Sequence: Synthetic polypeptide
  4.8H10H5[CTLA-4] variable heavy Chain
DVKLVESGGGLVKLGGSLKLSCAASGFTFNIYYMSWVRQTPEKRLELVAAINPDGGNTYYPDTVKGRFTISRDNAKNTLYLQMSSLKSEDSALYYCARYGGPGFDSWGQGTTLTVSS

SEQ ID NO: 3770 - protein, 5 aa, Artificial Sequence
  Description of Artificial Sequence: Synthetic peptide
  4.8H10H5[CTLA-4] vhCDR1
IYYMS

SEQ ID NO: 3771 - protein, 17 aa, Artificial Sequence
  Description of Artificial Sequence: Synthetic peptide
  4.8H10H5[CTLA-4] vhCDR2
AINPDGGNTYYPDTVKG

SEQ ID NO: 3772 - protein, 8 aa, Artificial Sequence
  Description of Artificial Sequence: Synthetic peptide
  4.8H10H5[CTLA-4] vhCDR3
YGGPGFDS

SEQ ID NO: 3773 - protein, 108 aa, Artificial Sequence
  Description of Artificial Sequence: Synthetic polypeptide
  4.8H10H5[CTLA-4] variable light Chain
ENVLTQSPAIMSASPGERVTMTCSASSSVSYMHWYQQKSNTSPKLWIYDTSKLASGVPGRFSGSGSRNSYSLTISSMEAEDVATYYCFPGSGFPFMYTFGGGTKLEIK

SEQ ID NO: 3774 - protein, 10 aa, Artificial Sequence
  Description of Artificial Sequence: Synthetic peptide
  4.8H10H5[CTLA-4] vlCDR1
SASSSVSYMH

SEQ ID NO: 3775 - protein, 7 aa, Artificial Sequence
  Description of Artificial Sequence: Synthetic peptide
  4.8H10H5[CTLA-4] vlCDR2
DTSKLAS

SEQ ID NO: 3776 - protein, 11 aa, Artificial Sequence
  Description of Artificial Sequence: Synthetic peptide
  4.8H10H5[CTLA-4] vlCDR3
FPGSGFPFMYT

SEQ ID NO: 3777 - protein, 116 aa, Artificial Sequence
  Description of Artificial Sequence: Synthetic polypeptide
  TGN2122.C[CTLA-4] variable heavy Chain
QVQLVQSGAEVKKPGASVKVSCKASGYTFTDYKIHWVRQAPGQGLEWIGYIYPYSGSSDYNQKFKSRATLTVDNSISTAYMELSRLRSDDTAVYYCARGGDAMDYWGQGTLVTVSS

SEQ ID NO: 3778 - protein, 5 aa, Artificial Sequence
  Description of Artificial Sequence: Synthetic peptide
  TGN2122.C[CTLA-4] vhCDR1
DYKIH

SEQ ID NO: 3779 - protein, 17 aa, Artificial Sequence
  Description of Artificial Sequence: Synthetic peptide
  TGN2122.C[CTLA-4] vhCDR2
YIYPYSGSSDYNQKFKS

SEQ ID NO: 3780 - protein, 7 aa, Artificial Sequence
  Description of Artificial Sequence: Synthetic peptide
  TGN2122.C[CTLA-4] vhCDR3
GGDAMDY

SEQ ID NO: 3781 - protein, 106 aa, Artificial Sequence
  Description of Artificial Sequence: Synthetic polypeptide
  TGN2122.C[CTLA-4] variable light Chain
DIQMTQSPSSLSASVGDRVTITCGASENIYGALNWYQRKPGKAPKLLIYGATNLADGVPSRFSGSGSGRDYTLTISSLQPEDFATYFCQNILGTWTFGGGTKVEIK

SEQ ID NO: 3782 - protein, 11 aa, Artificial Sequence
  Description of Artificial Sequence: Synthetic peptide
  TGN2122.C[CTLA-4] vlCDR1
GASENIYGALN

SEQ ID NO: 3783 - protein, 7 aa, Artificial Sequence
  Description of Artificial Sequence: Synthetic peptide
  TGN2122.C[CTLA-4] vlCDR2
GATNLAD

SEQ ID NO: 3784 - protein, 8 aa, Artificial Sequence
  Description of Artificial Sequence: Synthetic peptide
  TGN2122.C[CTLA-4] vlCDR3
QNILGTWT

SEQ ID NO: 3785 - protein, 117 aa, Artificial Sequence
  Description of Artificial Sequence: Synthetic polypeptide
  TGN2122.H[CTLA-4] variable heavy Chain
EVQLVESGGGLVQPGGSLRLSCAASGFTFNIYYMSWVRQAPGKGLELVAAINPDGGNTYYPDTVKGRFTISRDNAKNSLYLQMNSLRAEDTAVYYCARYGGPGFDSWGQGTLVTVSS

SEQ ID NO: 3786 - protein, 5 aa, Artificial Sequence
  Description of Artificial Sequence: Synthetic peptide
  TGN2122.H[CTLA-4] vhCDR1
IYYMS

SEQ ID NO: 3787 - protein, 17 aa, Artificial Sequence
  Description of Artificial Sequence: Synthetic peptide
  TGN2122.H[CTLA-4] vhCDR2
AINPDGGNTYYPDTVKG

SEQ ID NO: 3788 - protein, 8 aa, Artificial Sequence
  Description of Artificial Sequence: Synthetic peptide
  TGN2122.H[CTLA-4] vhCDR3
YGGPGFDS

SEQ ID NO: 3789 - protein, 108 aa, Artificial Sequence
  Description of Artificial Sequence: Synthetic polypeptide
  TGN2122.H[CTLA-4] variable light Chain
ENVLTQSPATLSLSPGERATLSCSASSSVSYMHWYQQKPGQAPRLWIYDTSKLASGIPARFSGSGSRNDYTLTISSLEPEDFAVYYCFPGSGFPFMYTFGGGTKVEIK

SEQ ID NO: 3790 - protein, 10 aa, Artificial Sequence
  Description of Artificial Sequence: Synthetic peptide
  TGN2122.H[CTLA-4] vlCDR1
SASSSVSYMH

SEQ ID NO: 3791 - protein, 7 aa, Artificial Sequence
  Description of Artificial Sequence: Synthetic peptide
  TGN2122.H[CTLA-4] vlCDR2
DTSKLAS

SEQ ID NO: 3792 - protein, 11 aa, Artificial Sequence
  Description of Artificial Sequence: Synthetic peptide
  TGN2122.H[CTLA-4] vlCDR3
FPGSGFPFMYT

SEQ ID NO: 3793 - protein, 123 aa, Artificial Sequence
  Description of Artificial Sequence: Synthetic polypeptide
  F7[CTLA-4] variable heavy Chain
QVQLVQSGAEVKKPGASVKVSCKASGYAFDGHYMHWVRQAPGQRLEWMGWVDPHSGATNYAQNFQGGVTMTRDTSINTVYMELSSLKSDDTAVYYCARDFYDTSAKSGAFDIWGQGTMVTVSS

SEQ ID NO: 3794 - protein, 5 aa, Artificial Sequence
  Description of Artificial Sequence: Synthetic peptide
  F7[CTLA-4] vhCDR1
GHYMH

SEQ ID NO: 3795 - protein, 17 aa, Artificial Sequence
  Description of Artificial Sequence: Synthetic peptide
  F7[CTLA-4] vhCDR2
WVDPHSGATNYAQNFQG

SEQ ID NO: 3796 - protein, 14 aa, Artificial Sequence
  Description of Artificial Sequence: Synthetic peptide
  F7[CTLA-4] vhCDR3
DFYDTSAKSGAFDI

SEQ ID NO: 3797 - protein, 107 aa, Artificial Sequence
  Description of Artificial Sequence: Synthetic polypeptide
  F7[CTLA-4] variable light Chain
AIQLTQSPSSVSASVGDRVTITCRASQGISSWLAWYQQKPGKAPKLLIYAASSLQSGVPSRFSGSGSGTDFTLTISSLQPEDFATYYCQQVNSFPWAFGQGTKVEIK

SEQ ID NO: 3798 - protein, 11 aa, Artificial Sequence
  Description of Artificial Sequence: Synthetic peptide
  F7[CTLA-4] vlCDR1
RASQGISSWLA

SEQ ID NO: 3799 - protein, 7 aa, Artificial Sequence
  Description of Artificial Sequence: Synthetic peptide
  F7[CTLA-4] vlCDR2
AASSLQS

SEQ ID NO: 3800 - protein, 9 aa, Artificial Sequence
  Description of Artificial Sequence: Synthetic peptide
  F7[CTLA-4] vlCDR3
QQVNSFPWA

SEQ ID NO: 3801 - protein, 121 aa, Artificial Sequence
  Description of Artificial Sequence: Synthetic polypeptide
  E8[CTLA-4] variable heavy Chain
QVQLVQSGAEVKKPGASVKVSCEASGYTFTNYYIHWLRQAPGQGLEWMGIINPSGGSTTYAQKFQGRITMTRDTSTNTLYMELSSLRSEDTAIYYCARRDCRGPSCYFAYWGQGTTVTVSS

SEQ ID NO: 3802 - protein, 5 aa, Artificial Sequence
  Description of Artificial Sequence: Synthetic peptide
  E8[CTLA-4] vhCDR1
NYYIH

SEQ ID NO: 3803 - protein, 17 aa, Artificial Sequence
  Description of Artificial Sequence: Synthetic peptide
  E8[CTLA-4] vhCDR2
IINPSGGSTTYAQKFQG

SEQ ID NO: 3804 - protein, 12 aa, Artificial Sequence
  Description of Artificial Sequence: Synthetic peptide
  E8[CTLA-4] vhCDR3
RDCRGPSCYFAY

SEQ ID NO: 3805 - protein, 107 aa, Artificial Sequence
  Description of Artificial Sequence: Synthetic polypeptide
  E8[CTLA-4] variable light Chain
DIVMTQSPSSLSASVGDRVTITCRASQSISSYLNWYQQKPGKAPKLLIYAASSLQSGVPPRFSGSGSGTEFTLTISSLQPEDFATYYCQQANSFPPTFGQGTKVDIK

SEQ ID NO: 3806 - protein, 11 aa, Artificial Sequence
  Description of Artificial Sequence: Synthetic peptide
  E8[CTLA-4] vlCDR1
RASQSISSYLN

SEQ ID NO: 3807 - protein, 7 aa, Artificial Sequence
  Description of Artificial Sequence: Synthetic peptide
  E8[CTLA-4] vlCDR2
AASSLQS

SEQ ID NO: 3808 - protein, 9 aa, Artificial Sequence
  Description of Artificial Sequence: Synthetic peptide
  E8[CTLA-4] vlCDR3
QQANSFPPT

SEQ ID NO: 3809 - protein, 114 aa, Artificial Sequence
  Description of Artificial Sequence: Synthetic polypeptide
  CT1E1[CTLA-4] variable heavy Chain
EVQLVESGGGLVQPGRSLRLSCRGSNFNFDDLAISWVRQAPGKGLEWLGFVRSKAYGETTDYVASVKGRFTISRDDSKFIAWLQMDSLKTDDTAVYYCTTFNYWGQGTLVTVSS

SEQ ID NO: 3810 - protein, 5 aa, Artificial Sequence
  Description of Artificial Sequence: Synthetic peptide
  CT1E1[CTLA-4] vhCDR1
DLAIS

SEQ ID NO: 3811 - protein, 19 aa, Artificial Sequence
  Description of Artificial Sequence: Synthetic peptide
  CT1E1[CTLA-4] vhCDR2
FVRSKAYGETTDYVASVKG

SEQ ID NO: 3812 - protein, 3 aa, Artificial Sequence
  Description of Artificial Sequence: Synthetic peptide
  CT1E1[CTLA-4] vhCDR3
FNY

SEQ ID NO: 3813 - protein, 108 aa, Artificial Sequence
  Description of Artificial Sequence: Synthetic polypeptide
  CT1E1[CTLA-4] variable light Chain
QPVLTQPPSVSVAPGKTARISCGGNNIASEAVHWYQKKPGQAPVLVIYYDSDRPSGIPERFSGSNSGNTATLRISRVDAGDEADYYCQVWDRTTDQPVFGGGTKLTVL

SEQ ID NO: 3814 - protein, 11 aa, Artificial Sequence
  Description of Artificial Sequence: Synthetic peptide
  CT1E1[CTLA-4] vlCDR1
GGNNIASEAVH

SEQ ID NO: 3815 - protein, 7 aa, Artificial Sequence
  Description of Artificial Sequence: Synthetic peptide
  CT1E1[CTLA-4] vlCDR2
YDSDRPS

SEQ ID NO: 3816 - protein, 11 aa, Artificial Sequence
  Description of Artificial Sequence: Synthetic peptide
  CT1E1[CTLA-4] vlCDR3
QVWDRTTDQPV

SEQ ID NO: 3817 - protein, 120 aa, Artificial Sequence
  Description of Artificial Sequence: Synthetic polypeptide
  BMS-986016[LAG-3] variable heavy Chain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSS

SEQ ID NO: 3818 - protein, 5 aa, Artificial Sequence
  Description of Artificial Sequence: Synthetic peptide
  BMS-986016[LAG-3] vhCDR1
DYYWN

SEQ ID NO: 3819 - protein, 16 aa, Artificial Sequence
  Description of Artificial Sequence: Synthetic peptide
  BMS-986016[LAG-3] vhCDR2
EINHRGSTNSNPSLKS

SEQ ID NO: 3820 - protein, 12 aa, Artificial Sequence
  Description of Artificial Sequence: Synthetic peptide
  BMS-986016[LAG-3] vhCDR3
GYSDYEYNWFDP

SEQ ID NO: 3821 - protein, 107 aa, Artificial Sequence
  Description of Artificial Sequence: Synthetic polypeptide
  BMS-986016[LAG-3] variable light Chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIK

SEQ ID NO: 3822 - protein, 11 aa, Artificial Sequence
  Description of Artificial Sequence: Synthetic peptide
  BMS-986016[LAG-3] vlCDR1
RASQSISSYLA

SEQ ID NO: 3823 - protein, 7 aa, Artificial Sequence
  Description of Artificial Sequence: Synthetic peptide
  BMS-986016[LAG-3] vlCDR2
DASNRAT

SEQ ID NO: 3824 - protein, 9 aa, Artificial Sequence
  Description of Artificial Sequence: Synthetic peptide
  BMS-986016[LAG-3] vlCDR3
QQRSNWPLT

SEQ ID NO: 3825 - protein, 116 aa, Artificial Sequence
  Description of Artificial Sequence: Synthetic polypeptide
  IMP731[LAG-3] variable heavy Chain
QVQLKESGPGLVAPSQSLSITCTVSGFSLTAYGVNWVRQPPGKGLEWLGMIWDDGSTDYNSALKSRLSISKDNSKSQVFLKMNSLQTDDTARYYCAREGDVAFDYWGQGTTLTVSS

SEQ ID NO: 3826 - protein, 5 aa, Artificial Sequence
  Description of Artificial Sequence: Synthetic peptide
  IMP731[LAG-3] vhCDR1
AYGVN

SEQ ID NO: 3827 - protein, 16 aa, Artificial Sequence
  Description of Artificial Sequence: Synthetic peptide
  IMP731[LAG-3] vhCDR2
MIWDDGSTDYNSALKS

SEQ ID NO: 3828 - protein, 8 aa, Artificial Sequence
  Description of Artificial Sequence: Synthetic peptide
  IMP731[LAG-3] vhCDR3
EGDVAFDY

SEQ ID NO: 3829 - protein, 113 aa, Artificial Sequence
  Description of Artificial Sequence: Synthetic polypeptide
  IMP731[LAG-3] variable light Chain
DIVMTQSPSSLAVSVGQKVTMSCKSSQSLLNGSNQKNYLAWYQQKPGQSPKLLVYFASTRDSGVPDRFIGSGSGTDFTLTISSVQAEDLADYFCLQHFGTPPTFGGGTKLEIK

SEQ ID NO: 3830 - protein, 17 aa, Artificial Sequence
  Description of Artificial Sequence: Synthetic peptide
  IMP731[LAG-3] vlCDR1
KSSQSLLNGSNQKNYLA

SEQ ID NO: 3831 - protein, 7 aa, Artificial Sequence
  Description of Artificial Sequence: Synthetic peptide
  IMP731[LAG-3] vlCDR2
FASTRDS

SEQ ID NO: 3832 - protein, 9 aa, Artificial Sequence
  Description of Artificial Sequence: Synthetic peptide
  IMP731[LAG-3] vlCDR3
LQHFGTPPT

SEQ ID NO: 3833 - protein, 123 aa, Artificial Sequence
  Description of Artificial Sequence: Synthetic polypeptide
  13E2[LAG-3] variable heavy Chain
QVTLKESGPGILQPSQTLSLTCSFSGFSLSTSGMGLGWIRQPSGKGLEWLTHIWWDDIKRYNPDLRSRLTISKDTSSSQIFLKIASVDTADTATYYCARIVEGSYSSSYFDVWGAGTTVTVSS

SEQ ID NO: 3834 - protein, 7 aa, Artificial Sequence
  Description of Artificial Sequence: Synthetic peptide
  13E2[LAG-3] vhCDR1
TSGMGLG

SEQ ID NO: 3835 - protein, 16 aa, Artificial Sequence
  Description of Artificial Sequence: Synthetic peptide
  13E2[LAG-3] vhCDR2
HIWWDDIKRYNPDLRS

SEQ ID NO: 3836 - protein, 13 aa, Artificial Sequence
  Description of Artificial Sequence: Synthetic peptide
  13E2[LAG-3] vhCDR3
IVEGSYSSSYFDV

SEQ ID NO: 3837 - protein, 107 aa, Artificial Sequence
  Description of Artificial Sequence: Synthetic polypeptide
  13E2[LAG-3] variable light Chain
DIVMTQPHKFMSTSVEDRVTITCKASQDVIFDVAWYQQKPGQSPKLLIYSASSRVSGVPDRFTGSGSGTDFTFTISSVQAEDLAVYYCQQHYSTPYTFGGGTTLEIK

SEQ ID NO: 3838 - protein, 11 aa, Artificial Sequence
  Description of Artificial Sequence: Synthetic peptide
  13E2[LAG-3] vlCDR1
KASQDVIFDVA

SEQ ID NO: 3839 - protein, 7 aa, Artificial Sequence
  Description of Artificial Sequence: Synthetic peptide
  13E2[LAG-3] vlCDR2
SASSRVS

SEQ ID NO: 3840 - protein, 9 aa, Artificial Sequence
  Description of Artificial Sequence: Synthetic peptide
  13E2[LAG-3] vlCDR3
QQHYSTPYT

SEQ ID NO: 3841 - protein, 123 aa, Artificial Sequence
  Description of Artificial Sequence: Synthetic polypeptide
  34F4[LAG-3] variable heavy Chain
QVTLKESGPGILQPSQTLSLTCSFSGFSLNTSGMGVGWIRQPSGKGLEWLTHIWWDDVKRYNPALKSRLTISKDTSSSQVFLKIASVDTADTATYYCARIEGDTYYDYYFDYWGQGVTLTVSS

SEQ ID NO: 3842 - protein, 7 aa, Artificial Sequence
  Description of Artificial Sequence: Synthetic peptide
  34F4[LAG-3] vhCDR1
TSGMGVG

SEQ ID NO: 3843 - protein, 16 aa, Artificial Sequence
  Description of Artificial Sequence: Synthetic peptide
  34F4[LAG-3] vhCDR2
HIWWDDVKRYNPALKS

SEQ ID NO: 3844 - protein, 13 aa, Artificial Sequence
  Description of Artificial Sequence: Synthetic peptide
  34F4[LAG-3] vhCDR3
IEGDTYYDYYFDY

SEQ ID NO: 3845 - protein, 107 aa, Artificial Sequence
  Description of Artificial Sequence: Synthetic polypeptide
  34F4[LAG-3] variable light Chain
DIVMTQSHKLMSTSVGDGLSITCKASQDVSIAVVWYQQKPGQSPKLLIYSASFRYTGVPDRFTGSGSGTDFTFTISSVQAEDLAVYYCQQHYSIPWTFGGGTKLEIK

SEQ ID NO: 3846 - protein, 11 aa, Artificial Sequence
  Description of Artificial Sequence: Synthetic peptide
  34F4[LAG-3] vlCDR1
KASQDVSIAVV

SEQ ID NO: 3847 - protein, 7 aa, Artificial Sequence
  Description of Artificial Sequence: Synthetic peptide
  34F4[LAG-3] vlCDR2
SASFRYT

SEQ ID NO: 3848 - protein, 9 aa, Artificial Sequence
  Description of Artificial Sequence: Synthetic peptide
  34F4[LAG-3] vlCDR3
QQHYSIPWT

SEQ ID NO: 3849 - protein, 123 aa, Artificial Sequence
  Description of Artificial Sequence: Synthetic polypeptide
  IMP761[LAG-3] variable heavy Chain
QITLKESGPTLVKPTQTLTLTCTFSGFSLSTSGMGLGWIRQPPGKTLEWLTHIWWDDIKRYNPDLRSRLSITKDTSKNQVVLTMTNMDPLDTGTYYCARIVEGSYSSSYFDVWGQGTLVTVSS

SEQ ID NO: 3850 - protein, 7 aa, Artificial Sequence
  Description of Artificial Sequence: Synthetic peptide
  IMP761[LAG-3] vhCDR1
TSGMGLG

SEQ ID NO: 3851 - protein, 16 aa, Artificial Sequence
  Description of Artificial Sequence: Synthetic peptide
  IMP761[LAG-3] vhCDR2
HIWWDDIKRYNPDLRS

SEQ ID NO: 3852 - protein, 13 aa, Artificial Sequence
  Description of Artificial Sequence: Synthetic peptide
  IMP761[LAG-3] vhCDR3
IVEGSYSSSYFDV

SEQ ID NO: 3853 - protein, 107 aa, Artificial Sequence
  Description of Artificial Sequence: Synthetic polypeptide
  IMP761[LAG-3] variable light Chain
DIVMTQTPSSLSASVGDRVTITCKASQDVIFDVAWYQQRPGQAPKLLIYSASSRVSGVPSRFSGSGSGTDFTLTISSLQPEDFATYYCQQHYSTPYTFGQGTRLDIK

SEQ ID NO: 3854 - protein, 11 aa, Artificial Sequence
  Description of Artificial Sequence: Synthetic peptide
  IMP761[LAG-3] vlCDR1
KASQDVIFDVA

SEQ ID NO: 3855 - protein, 7 aa, Artificial Sequence
  Description of Artificial Sequence: Synthetic peptide
  IMP761[LAG-3] vlCDR2
SASSRVS

SEQ ID NO: 3856 - protein, 9 aa, Artificial Sequence
  Description of Artificial Sequence: Synthetic peptide
  IMP761[LAG-3] vlCDR3
QQHYSTPYT

SEQ ID NO: 3857 - protein, 116 aa, Artificial Sequence
  Description of Artificial Sequence: Synthetic polypeptide
  H5L7[LAG-3] variable heavy Chain
QVQLQESGPGLVKPSETLSLTCTVSGFSLTAYGVNWIRQPPGKGLEWIGMIWDDGSTDYDSALKSRVTISVDTSKNQFSLKLSSVTAADTAVYYCAREGDVAFDYWGQGTLVTVSS

SEQ ID NO: 3858 - protein, 5 aa, Artificial Sequence
  Description of Artificial Sequence: Synthetic peptide
  H5L7[LAG-3] vhCDR1
AYGVN

SEQ ID NO: 3859 - protein, 16 aa, Artificial Sequence
  Description of Artificial Sequence: Synthetic peptide
  H5L7[LAG-3] vhCDR2
MIWDDGSTDYDSALKS

SEQ ID NO: 3860 - protein, 8 aa, Artificial Sequence
  Description of Artificial Sequence: Synthetic peptide
  H5L7[LAG-3] vhCDR3
EGDVAFDY

SEQ ID NO: 3861 - protein, 113 aa, Artificial Sequence
  Description of Artificial Sequence: Synthetic polypeptide
  H5L7[LAG-3] variable light Chain
DIQMTQSPSSLSASVGDRVTITCKSSQSLLNPSNQKNYLAWYQQKPGKAPKLLVYFASTRDSGVPSRFSGSGSGTDFTLTISSLQPEDFATYYCLQHFGTPPTFGQGTKLEIK

SEQ ID NO: 3862 - protein, 17 aa, Artificial Sequence
  Description of Artificial Sequence: Synthetic peptide
  H5L7[LAG-3] vlCDR1
KSSQSLLNPSNQKNYLA

SEQ ID NO: 3863 - protein, 7 aa, Artificial Sequence
  Description of Artificial Sequence: Synthetic peptide
  H5L7[LAG-3] vlCDR2
FASTRDS

SEQ ID NO: 3864 - protein, 9 aa, Artificial Sequence
  Description of Artificial Sequence: Synthetic peptide
  H5L7[LAG-3] vlCDR3
LQHFGTPPT

SEQ ID NO: 3865 - protein, 119 aa, Artificial Sequence
  Description of Artificial Sequence: Synthetic polypeptide
  hu22D2[LAG-3] variable heavy Chain
QMQLVQSGPEVKKPGTSVKVSCKASGYTFTDYNVDWVRQARGQRLEWIGDINPNNGGTIYAQKFQERVTITVDKSTSTAYMELSSLRSEDTAVYYCARNYRWFGAMDHWGQGTTVTVSS

SEQ ID NO: 3866 - protein, 5 aa, Artificial Sequence
  Description of Artificial Sequence: Synthetic peptide
  hu22D2[LAG-3] vhCDR1
DYNVD

SEQ ID NO: 3867 - protein, 17 aa, Artificial Sequence
  Description of Artificial Sequence: Synthetic peptide
  hu22D2[LAG-3] vhCDR2
DINPNNGGTIYAQKFQE

SEQ ID NO: 3868 - protein, 10 aa, Artificial Sequence
  Description of Artificial Sequence: Synthetic peptide
  hu22D2[LAG-3] vhCDR3
NYRWFGAMDH

SEQ ID NO: 3869 - protein, 111 aa, Artificial Sequence
  Description of Artificial Sequence: Synthetic polypeptide
  hu22D2[LAG-3] variable light Chain
DIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIK

SEQ ID NO: 3870 - protein, 15 aa, Artificial Sequence
  Description of Artificial Sequence: Synthetic peptide
  hu22D2[LAG-3] vlCDR1
KASQSLDYEGDSDMN

SEQ ID NO: 3871 - protein, 7 aa, Artificial Sequence
  Description of Artificial Sequence: Synthetic peptide
  hu22D2[LAG-3] vlCDR2
GASNLES

SEQ ID NO: 3872 - protein, 9 aa, Artificial Sequence
  Description of Artificial Sequence: Synthetic peptide
  hu22D2[LAG-3] vlCDR3
QQSTEDPRT

SEQ ID NO: 3873 - protein, 123 aa, Artificial Sequence
  Description of Artificial Sequence: Synthetic polypeptide
  H4sH15482P[LAG-3] variable heavy Chain
QVQLVESGGGVVQPGRSLRLSCVASGFTFSSYGMHWVRQAPGKGLEWVAIIWYDGSNKYYADSVKGRFTISRDNSKNTQYLQMNSLRAEDTAVYYCASVATSGDFDYYGMDVWGQGTTVTVSS

SEQ ID NO: 3874 - protein, 5 aa, Artificial Sequence
  Description of Artificial Sequence: Synthetic peptide
  H4sH15482P[LAG-3] vhCDR1
SYGMH

SEQ ID NO: 3875 - protein, 17 aa, Artificial Sequence
  Description of Artificial Sequence: Synthetic peptide
  H4sH15482P[LAG-3] vhCDR2
IIWYDGSNKYYADSVKG

SEQ ID NO: 3876 - protein, 14 aa, Artificial Sequence
  Description of Artificial Sequence: Synthetic peptide
  H4sH15482P[LAG-3] vhCDR3
VATSGDFDYYGMDV

SEQ ID NO: 3877 - protein, 107 aa, Artificial Sequence
  Description of Artificial Sequence: Synthetic polypeptide
  H4sH15482P[LAG-3] variable light Chain
EIVLTQSPATLSLSPGERTTLSCRASQRISTYLAWYQQKPGQAPRLLIYDASKRATGIPARFSGSGSGTGFTLTISSLEPEDFAVYYCQQRSNWPLTFGGGTKVEIK

SEQ ID NO: 3878 - protein, 11 aa, Artificial Sequence
  Description of Artificial Sequence: Synthetic peptide
  H4sH15482P[LAG-3] vlCDR1
RASQRISTYLA

SEQ ID NO: 3879 - protein, 7 aa, Artificial Sequence
  Description of Artificial Sequence: Synthetic peptide
  H4sH15482P[LAG-3] vlCDR2
DASKRAT

SEQ ID NO: 3880 - protein, 9 aa, Artificial Sequence
  Description of Artificial Sequence: Synthetic peptide
  H4sH15482P[LAG-3] vlCDR3
QQRSNWPLT

SEQ ID NO: 3881 - protein, 119 aa, Artificial Sequence
  Description of Artificial Sequence: Synthetic polypeptide
  L35D4[LAG-3] variable heavy Chain
QVQLVQSGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 3882 - protein, 5 aa, Artificial Sequence
  Description of Artificial Sequence: Synthetic peptide
  L35D4[LAG-3] vhCDR1
SYYMH

SEQ ID NO: 3883 - protein, 17 aa, Artificial Sequence
  Description of Artificial Sequence: Synthetic peptide
  L35D4[LAG-3] vhCDR2
IINPSAGSTSYAQKFQG

SEQ ID NO: 3884 - protein, 10 aa, Artificial Sequence
  Description of Artificial Sequence: Synthetic peptide
  L35D4[LAG-3] vhCDR3
ELMATGGFDY

SEQ ID NO: 3885 - protein, 112 aa, Artificial Sequence
  Description of Artificial Sequence: Synthetic polypeptide
  L35D4[LAG-3] variable light Chain
QSVLTQPPSASGSPGQSVTISCTGTSSDVGGYNYVSWYQQYPGKAPRLMIFEVTERASGVPDRFSGSKSGNTASLTVSGLQTEDEAVYFCSSYSGSNNPGAMFGGGTKLTVL

SEQ ID NO: 3886 - protein, 14 aa, Artificial Sequence
  Description of Artificial Sequence: Synthetic peptide
  L35D4[LAG-3] vlCDR1
TGTSSDVGGYNYVS

SEQ ID NO: 3887 - protein, 7 aa, Artificial Sequence
  Description of Artificial Sequence: Synthetic peptide
  L35D4[LAG-3] vlCDR2
EVTERAS

SEQ ID NO: 3888 - protein, 12 aa, Artificial Sequence
  Description of Artificial Sequence: Synthetic peptide
  L35D4[LAG-3] vlCDR3
SSYSGSNNPGAM

SEQ ID NO: 3889 - protein, 119 aa, Artificial Sequence; identical to SEQ ID NO: 3881
  Description of Artificial Sequence: Synthetic polypeptide
  L35G6[LAG-3] variable heavy Chain

SEQ ID NO: 3890 - protein, 5 aa, Artificial Sequence
  Description of Artificial Sequence: Synthetic peptide
  L35G6[LAG-3] vhCDR1
SYYMH

SEQ ID NO: 3891 - protein, 17 aa, Artificial Sequence
  Description of Artificial Sequence: Synthetic peptide
  L35G6[LAG-3] vhCDR2
IINPSAGSTSYAQKFQG

SEQ ID NO: 3892 - protein, 10 aa, Artificial Sequence
  Description of Artificial Sequence: Synthetic peptide
  L35G6[LAG-3] vhCDR3
ELMATGGFDY

SEQ ID NO: 3893 - protein, 110 aa, Artificial Sequence
  Description of Artificial Sequence: Synthetic polypeptide
  L35G6[LAG-3] variable light Chain
QAGLTQPASVSGSPGQSITISCTGSSSDVGGYSYVSWYQKHPGKAPKLMIYDVTNRPSGVSNRFSGSKSGNTASLTISGLQAEDEADYYCSTYTRSNTLVFGPGTKVTVL

SEQ ID NO: 3894 - protein, 14 aa, Artificial Sequence
  Description of Artificial Sequence: Synthetic peptide
  L35G6[LAG-3] vlCDR1
TGSSSDVGGYSYVS

SEQ ID NO: 3895 - protein, 7 aa, Artificial Sequence
  Description of Artificial Sequence: Synthetic peptide
  L35G6[LAG-3] vlCDR2
DVTNRPS

SEQ ID NO: 3896 - protein, 10 aa, Artificial Sequence
  Description of Artificial Sequence: Synthetic peptide
  L35G6[LAG-3] vlCDR3
STYTRSNTLV

SEQ ID NO: 3897 - protein, 119 aa, Artificial Sequence; identical to SEQ ID NO: 3881
  Description of Artificial Sequence: Synthetic polypeptide
  L33H11[LAG-3] variable heavy Chain

SEQ ID NO: 3898 - protein, 5 aa, Artificial Sequence
  Description of Artificial Sequence: Synthetic peptide
  L33H11[LAG-3] vhCDR1
SYYMH

SEQ ID NO: 3899 - protein, 17 aa, Artificial Sequence
  Description of Artificial Sequence: Synthetic peptide
  L33H11[LAG-3] vhCDR2
IINPSAGSTSYAQKFQG

SEQ ID NO: 3900 - protein, 10 aa, Artificial Sequence
  Description of Artificial Sequence: Synthetic peptide
  L33H11[LAG-3] vhCDR3
ELMATGGFDY

SEQ ID NO: 3901 - protein, 110 aa, Artificial Sequence
  Description of Artificial Sequence: Synthetic polypeptide
  L33H11[LAG-3] variable light Chain
LPVLTQPASVSGSPGQSITISCTGTSSDVGGYNYVSWYQQHPGKAPKLMIYDVTNRPSGVSNRFSGSKSGNTASLTISGLQAEDEADYYCSSYTSSNTLLFGGGTQLTVL

SEQ ID NO: 3902 - protein, 14 aa, Artificial Sequence
  Description of Artificial Sequence: Synthetic peptide
  L33H11[LAG-3] vlCDR1
TGTSSDVGGYNYVS

SEQ ID NO: 3903 - protein, 7 aa, Artificial Sequence
  Description of Artificial Sequence: Synthetic peptide
  L33H11[LAG-3] vlCDR2
DVTNRPS

SEQ ID NO: 3904 - protein, 10 aa, Artificial Sequence
  Description of Artificial Sequence: Synthetic peptide
  L33H11[LAG-3] vlCDR3
SSYTSSNTLL

SEQ ID NO: 3905 - protein, 119 aa, Artificial Sequence; identical to SEQ ID NO: 3881
  Description of Artificial Sequence: Synthetic polypeptide
  L32A9[LAG-3] variable heavy Chain

SEQ ID NO: 3906 - protein, 5 aa, Artificial Sequence
  Description of Artificial Sequence: Synthetic peptide
  L32A9[LAG-3] vhCDR1
SYYMH

SEQ ID NO: 3907 - protein, 17 aa, Artificial Sequence
  Description of Artificial Sequence: Synthetic peptide
  L32A9[LAG-3] vhCDR2
IINPSAGSTSYAQKFQG

SEQ ID NO: 3908 - protein, 10 aa, Artificial Sequence
  Description of Artificial Sequence: Synthetic peptide
  L32A9[LAG-3] vhCDR3
ELMATGGFDY

SEQ ID NO: 3909 - protein, 110 aa, Artificial Sequence
  Description of Artificial Sequence: Synthetic polypeptide
  L32A9[LAG-3] variable light Chain
QSVVTQPPSVSAAPGQKVTISCSGSSSNIGNNYVSWYQQLPGTAPKLLIYDNNKRHSGIPDRFSGSTSDTSATLGITRLQTGDEADYYCGTWDSSLSAYVFGTGTKVTVL

SEQ ID NO: 3910 - protein, 13 aa, Artificial Sequence
  Description of Artificial Sequence: Synthetic peptide
  L32A9[LAG-3] vlCDR1
SGSSSNIGNNYVS

SEQ ID NO: 3911 - protein, 7 aa, Artificial Sequence
  Description of Artificial Sequence: Synthetic peptide
  L32A9[LAG-3] vlCDR2
DNNKRHS

SEQ ID NO: 3912 - protein, 11 aa, Artificial Sequence
  Description of Artificial Sequence: Synthetic peptide
  L32A9[LAG-3] vlCDR3
GTWDSSLSAYV

SEQ ID NO: 3913 - protein, 119 aa, Artificial Sequence; identical to SEQ ID NO: 3881
  Description of Artificial Sequence: Synthetic polypeptide
  L32D10[LAG-3] variable heavy Chain

SEQ ID NO: 3914 - protein, 5 aa, Artificial Sequence
  Description of Artificial Sequence: Synthetic peptide
  L32D10[LAG-3] vhCDR1
SYYMH

SEQ ID NO: 3915 - protein, 17 aa, Artificial Sequence
  Description of Artificial Sequence: Synthetic peptide
  L32D10[LAG-3] vhCDR2
IINPSAGSTSYAQKFQG

SEQ ID NO: 3916 - protein, 10 aa, Artificial Sequence
  Description of Artificial Sequence: Synthetic peptide
  L32D10[LAG-3] vhCDR3
ELMATGGFDY

SEQ ID NO: 3917 - protein, 110 aa, Artificial Sequence
  Description of Artificial Sequence: Synthetic polypeptide
  L32D10[LAG-3] variable light Chain
QSVLTQPPSASGSPGQSVTISCTGTSSDVGGYDYVSWYQQHQGKAPKLMIYDVSNRPSGVSNRFSGSKSGNTASLTISGLQAEDEADYYCSSYTSSTTLVFGGGTKLTVL

SEQ ID NO: 3918 - protein, 14 aa, Artificial Sequence
  Description of Artificial Sequence: Synthetic peptide
  L32D10[LAG-3] vlCDR1
TGTSSDVGGYDYVS

SEQ ID NO: 3919 - protein, 7 aa, Artificial Sequence
  Description of Artificial Sequence: Synthetic peptide
  L32D10[LAG-3] vlCDR2
DVSNRPS

SEQ ID NO: 3920 - protein, 10 aa, Artificial Sequence
  Description of Artificial Sequence: Synthetic peptide
  L32D10[LAG-3] vlCDR3
SSYTSSTTLV

SEQ ID NO: 3921 - protein, 119 aa, Artificial Sequence; identical to SEQ ID NO: 3881
  Description of Artificial Sequence: Synthetic polypeptide
  L32A4[LAG-3] variable heavy Chain

SEQ ID NO: 3922 - protein, 5 aa, Artificial Sequence
  Description of Artificial Sequence: Synthetic peptide
  L32A4[LAG-3] vhCDR1
SYYMH

SEQ ID NO: 3923 - protein, 17 aa, Artificial Sequence
  Description of Artificial Sequence: Synthetic peptide
  L32A4[LAG-3] vhCDR2
IINPSAGSTSYAQKFQG

SEQ ID NO: 3924 - protein, 10 aa, Artificial Sequence
  Description of Artificial Sequence: Synthetic peptide
  L32A4[LAG-3] vhCDR3
ELMATGGFDY

SEQ ID NO: 3925 - protein, 110 aa, Artificial Sequence
  Description of Artificial Sequence: Synthetic polypeptide
  L32A4[LAG-3] variable light Chain
QSVLTQPASVSGSPGQSITISCTGTSSDIGAYNFVSWYQQHPGKAPKLMIYGVSNRPSGVSSRFSGSKSGSTASLTISGLQAEDEADYYCSSYTTSGSAVFGTGTKLTVL

SEQ ID NO: 3926 - protein, 14 aa, Artificial Sequence
  Description of Artificial Sequence: Synthetic peptide
  L32A4[LAG-3] vlCDR1
TGTSSDIGAYNFVS

SEQ ID NO: 3927 - protein, 7 aa, Artificial Sequence
  Description of Artificial Sequence: Synthetic peptide
  L32A4[LAG-3] vlCDR2
GVSNRPS

SEQ ID NO: 3928 - protein, 10 aa, Artificial Sequence
  Description of Artificial Sequence: Synthetic peptide
  L32A4[LAG-3] vlCDR3
SSYTTSGSAV

SEQ ID NO: 3929 - protein, 119 aa, Artificial Sequence
  Description of Artificial Sequence: Synthetic polypeptide
  L3A1[LAG-3] variable heavy Chain
EVQLLESGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 3930 - protein, 5 aa, Artificial Sequence
  Description of Artificial Sequence: Synthetic peptide
  L3A1[LAG-3] vhCDR1
SYYMH

SEQ ID NO: 3931 - protein, 17 aa, Artificial Sequence
  Description of Artificial Sequence: Synthetic peptide
  L3A1[LAG-3] vhCDR2
IINPSAGSTSYAQKFQG

SEQ ID NO: 3932 - protein, 10 aa, Artificial Sequence
  Description of Artificial Sequence: Synthetic peptide
  L3A1[LAG-3] vhCDR3
ELMATGGFDY

SEQ ID NO: 3933 - protein, 110 aa, Artificial Sequence
  Description of Artificial Sequence: Synthetic polypeptide
  L3A1[LAG-3] variable light Chain
QSVLTQPASVSGSPGQSITISCTGTSSDIGAYNFVSWYQQHPGKAPKLMIYGVSNRPSGVSSRFSGSKSGSTASLTITGLQAEDEADYYCSSYTTSGSAVFGTGTKLTVL

SEQ ID NO: 3934 - protein, 14 aa, Artificial Sequence
  Description of Artificial Sequence: Synthetic peptide
  L3A1[LAG-3] vlCDR1
TGTSSDIGAYNFVS

SEQ ID NO: 3935 - protein, 7 aa, Artificial Sequence
  Description of Artificial Sequence: Synthetic peptide
  L3A1[LAG-3] vlCDR2
GVSNRPS

SEQ ID NO: 3936 - protein, 10 aa, Artificial Sequence
  Description of Artificial Sequence: Synthetic peptide
  L3A1[LAG-3] vlCDR3
SSYTTSGSAV

SEQ ID NO: 3937 - protein, 121 aa, Artificial Sequence
  Description of Artificial Sequence: Synthetic polypeptide
  L3A10[LAG-3] variable heavy Chain
EVQLLESGGGVVQPGRSLRVSCAASGFTFSNHAMHWVRQAPGKGLEWVAVISYDGSKKFYSDSVRGRFTISRDNSKNTLYLQMNSLRPEDTAVYYCAKGAHGYTSGWHDYWGQGTLVTVSS

SEQ ID NO: 3938 - protein, 5 aa, Artificial Sequence
  Description of Artificial Sequence: Synthetic peptide
  L3A10[LAG-3] vhCDR1
NHAMH

SEQ ID NO: 3939 - protein, 17 aa, Artificial Sequence
  Description of Artificial Sequence: Synthetic peptide
  L3A10[LAG-3] vhCDR2
VISYDGSKKFYSDSVRG

SEQ ID NO: 3940 - protein, 12 aa, Artificial Sequence
  Description of Artificial Sequence: Synthetic peptide
  L3A10[LAG-3] vhCDR3
GAHGYTSGWHDY

SEQ ID NO: 3941 - protein, 108 aa, Artificial Sequence
  Description of Artificial Sequence: Synthetic polypeptide
  L3A10[LAG-3] variable light Chain
DVVMTQSPSSLSASVGDRVSITCRASQNIGRYLNWYQQKPGKAPKLLVSAASSLQGGVPSRFSGSGSGTDFTLTISRLQPEDFATYFCQQTYSSPQCTFGQGTKVDIK

SEQ ID NO: 3942 - protein, 11 aa, Artificial Sequence
  Description of Artificial Sequence: Synthetic peptide
  L3A10[LAG-3] vlCDR1
RASQNIGRYLN

SEQ ID NO: 3943 - protein, 7 aa, Artificial Sequence
  Description of Artificial Sequence: Synthetic peptide
  L3A10[LAG-3] vlCDR2
AASSLQG

SEQ ID NO: 3944 - protein, 10 aa, Artificial Sequence
  Description of Artificial Sequence: Synthetic peptide
  L3A10[LAG-3] vlCDR3
QQTYSSPQCT

SEQ ID NO: 3945 - protein, 121 aa, Artificial Sequence
  Description of Artificial Sequence: Synthetic polypeptide
  L3C5[LAG-3] variable heavy Chain
QVQLVQSGSELKKPGASVKVSCKASGYTFTNYYMHWVRQAPGQGLEWMGIINPSGGATNYAQKFQGRVTMTRDTSTSTVYMELSSLRSEDTAVYYCARDSGYDLGYGMDVWGQGTLVTVSS

SEQ ID NO: 3946 - protein, 5 aa, Artificial Sequence
  Description of Artificial Sequence: Synthetic peptide
  L3C5[LAG-3] vhCDR1
NYYMH

SEQ ID NO: 3947 - protein, 17 aa, Artificial Sequence
  Description of Artificial Sequence: Synthetic peptide
  L3C5[LAG-3] vhCDR2
IINPSGGATNYAQKFQG

SEQ ID NO: 3948 - protein, 12 aa, Artificial Sequence
  Description of Artificial Sequence: Synthetic peptide
  L3C5[LAG-3] vhCDR3
DSGYDLGYGMDV

SEQ ID NO: 3949 - protein, 110 aa, Artificial Sequence
  Description of Artificial Sequence: Synthetic polypeptide
  L3C5[LAG-3] variable light Chain
QSVLTQPASVSGSPGQSITISCTGTSSDVGGYNYVSWYQQHPGKAPKLMIYDVSNRPSGASNRFSGSKSGNTASLTISGLQAEDEADYYCSSYTNRNTLLFGGGTKLTVL

SEQ ID NO: 3950 - protein, 14 aa, Artificial Sequence
  Description of Artificial Sequence: Synthetic peptide
  L3C5[LAG-3] vlCDR1
TGTSSDVGGYNYVS

SEQ ID NO: 3951 - protein, 7 aa, Artificial Sequence
  Description of Artificial Sequence: Synthetic peptide
  L3C5[LAG-3] vlCDR2
DVSNRPS

SEQ ID NO: 3952 - protein, 10 aa, Artificial Sequence
  Description of Artificial Sequence: Synthetic peptide
  L3C5[LAG-3] vlCDR3
SSYTNRNTLL

SEQ ID NO: 3953 - protein, 119 aa, Artificial Sequence; identical to SEQ ID NO: 3929
  Description of Artificial Sequence: Synthetic polypeptide
  L3E3[LAG-3] variable heavy Chain

SEQ ID NO: 3954 - protein, 5 aa, Artificial Sequence
  Description of Artificial Sequence: Synthetic peptide
  L3E3[LAG-3] vhCDR1
SYYMH

SEQ ID NO: 3955 - protein, 17 aa, Artificial Sequence
  Description of Artificial Sequence: Synthetic peptide
  L3E3[LAG-3] vhCDR2
IINPSAGSTSYAQKFQG

SEQ ID NO: 3956 - protein, 10 aa, Artificial Sequence
  Description of Artificial Sequence: Synthetic peptide
  L3E3[LAG-3] vhCDR3
ELMATGGFDY

SEQ ID NO: 3957 - protein, 110 aa, Artificial Sequence
  Description of Artificial Sequence: Synthetic polypeptide
  L3E3[LAG-3] variable light Chain
QSVLTQPASASGSPGQSITISCTGTSSDVGGYNYVSWYQQHPGKAPKLMIYDVSNRPSGVSNRFSGSKSGNTASLTISGLQAEDEANYYCSSYTSSSTNVFGTGTKVTVL

SEQ ID NO: 3958 - protein, 14 aa, Artificial Sequence
  Description of Artificial Sequence: Synthetic peptide
  L3E3[LAG-3] vlCDR1
TGTSSDVGGYNYVS

SEQ ID NO: 3959 - protein, 7 aa, Artificial Sequence
  Description of Artificial Sequence: Synthetic peptide
  L3E3[LAG-3] vlCDR2
DVSNRPS

SEQ ID NO: 3960 - protein, 10 aa, Artificial Sequence
  Description of Artificial Sequence: Synthetic peptide
  L3E3[LAG-3] vlCDR3
SSYTSSSTNV

SEQ ID NO: 3961 - protein, 121 aa, Artificial Sequence
  Description of Artificial Sequence: Synthetic polypeptide
  durvalumab[PD-L1] variable heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 3962 - protein, 5 aa, Artificial Sequence
  Description of Artificial Sequence: Synthetic peptide
  durvalumab[PD-L1] vhCDR1
RYWMS

SEQ ID NO: 3963 - protein, 17 aa, Artificial Sequence
  Description of Artificial Sequence: Synthetic peptide
  durvalumab[PD-L1] vhCDR2
NIKQDGSEKYYVDSVKG

SEQ ID NO: 3964 - protein, 12 aa, Artificial Sequence
  Description of Artificial Sequence: Synthetic peptide
  durvalumab[PD-L1] vhCDR3
EGGWFGELAFDY

SEQ ID NO: 3965 - protein, 108 aa, Artificial Sequence
  Description of Artificial Sequence: Synthetic polypeptide
  durvalumab[PD-L1] variable light Chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 3966 - protein, 12 aa, Artificial Sequence
  Description of Artificial Sequence: Synthetic peptide
  durvalumab[PD-L1] vlCDR1
RASQRVSSSYLA

SEQ ID NO: 3967 - protein, 7 aa, Artificial Sequence
  Description of Artificial Sequence: Synthetic peptide
  durvalumab[PD-L1] vlCDR2
DASSRAT

SEQ ID NO: 3968 - protein, 9 aa, Artificial Sequence
  Description of Artificial Sequence: Synthetic peptide
  durvalumab[PD-L1] vlCDR3
QQYGSLPWT

SEQ ID NO: 3969 - protein, 118 aa, Artificial Sequence
  Description of Artificial Sequence: Synthetic polypeptide
  atezolizumab[PD-L1] variable heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 3970 - protein, 5 aa, Artificial Sequence
  Description of Artificial Sequence: Synthetic peptide
  atezolizumab[PD-L1] vhCDR1
DSWIH

SEQ ID NO: 3971 - protein, 17 aa, Artificial Sequence
  Description of Artificial Sequence: Synthetic peptide
  atezolizumab[PD-L1] vhCDR2
WISPYGGSTYYADSVKG

SEQ ID NO: 3972 - protein, 9 aa, Artificial Sequence
  Description of Artificial Sequence: Synthetic peptide
  atezolizumab[PD-L1] vhCDR3
RHWPGGFDY

SEQ ID NO: 3973 - protein, 108 aa, Artificial Sequence
  Description of Artificial Sequence: Synthetic polypeptide
  atezolizumab[PD-L1] variable light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 3974 - protein, 11 aa, Artificial Sequence
  Description of Artificial Sequence: Synthetic peptide
  atezolizumab[PD-L1] vlCDR1
RASQDVSTAVA

SEQ ID NO: 3975 - protein, 7 aa, Artificial Sequence
  Description of Artificial Sequence: Synthetic peptide
  atezolizumab[PD-L1] vlCDR2
SASFLYS

SEQ ID NO: 3976 - protein, 9 aa, Artificial Sequence
  Description of Artificial Sequence: Synthetic peptide
  atezolizumab[PD-L1] vlCDR3
QQYLYHPAT

SEQ ID NO: 3977 - protein, 120 aa, Artificial Sequence
  Description of Artificial Sequence: Synthetic polypeptide
  A09-246-2[PD-L1] variable heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 3978 - protein, 5 aa, Artificial Sequence
  Description of Artificial Sequence: Synthetic peptide
  A09-246-2[PD-L1] vhCDR1
SYIMM

SEQ ID NO: 3979 - protein, 17 aa, Artificial Sequence
  Description of Artificial Sequence: Synthetic peptide
  A09-246-2[PD-L1] vhCDR2
SIYPSGGITFYADTVKG

SEQ ID NO: 3980 - protein, 11 aa, Artificial Sequence
  Description of Artificial Sequence: Synthetic peptide
  A09-246-2[PD-L1] vhCDR3
IKLGTVTTVDY

SEQ ID NO: 3981 - protein, 110 aa, Artificial Sequence
  Description of Artificial Sequence: Synthetic polypeptide
  A09-246-2[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 3982 - protein, 14 aa, Artificial Sequence
  Description of Artificial Sequence: Synthetic peptide
  A09-246-2[PD-L1] vlCDR1
TGTSSDVGGYNYVS

SEQ ID NO: 3983 - protein, 7 aa, Artificial Sequence
  Description of Artificial Sequence: Synthetic peptide
  A09-246-2[PD-L1] vlCDR2
DVSNRPS

SEQ ID NO: 3984 - protein, 10 aa, Artificial Sequence
  Description of Artificial Sequence: Synthetic peptide
  A09-246-2[PD-L1] vlCDR3
SSYTSSSTRV

SEQ ID NO: 3985 - protein, 123 aa, Artificial Sequence
  Description of Artificial Sequence: Synthetic polypeptide
  12A4[PD-L1] variable heavy Chain
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 3986 - protein, 5 aa, Artificial Sequence
  Description of Artificial Sequence: Synthetic peptide
  12A4[PD-L1] vhCDR1
TYAIS

SEQ ID NO: 3987 - protein, 17 aa, Artificial Sequence
  Description of Artificial Sequence: Synthetic peptide
  12A4[PD-L1] vhCDR2
GIIPIFGKAHYAQKFQG

SEQ ID NO: 3988 - protein, 14 aa, Artificial Sequence
  Description of Artificial Sequence: Synthetic peptide
  12A4[PD-L1] vhCDR3
KFHFVSGSPFGMDV

SEQ ID NO: 3989 - protein, 106 aa, Artificial Sequence
  Description of Artificial Sequence: Synthetic polypeptide
  12A4[PD-L1] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 3990 - protein, 11 aa, Artificial Sequence
  Description of Artificial Sequence: Synthetic peptide
  12A4[PD-L1] vlCDR1
RASQSVSSYLA

SEQ ID NO: 3991 - protein, 7 aa, Artificial Sequence
  Description of Artificial Sequence: Synthetic peptide
  12A4[PD-L1] vlCDR2
DASNRAT

SEQ ID NO: 3992 - protein, 8 aa, Artificial Sequence
  Description of Artificial Sequence: Synthetic peptide
  12A4[PD-L1] vlCDR3
QQRSNWPT

SEQ ID NO: 3993 - protein, 117 aa, Artificial Sequence
  Description of Artificial Sequence: Synthetic polypeptide
  3G10[PD-L1] variable heavy Chain
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 3994 - protein, 5 aa, Artificial Sequence
  Description of Artificial Sequence: Synthetic peptide
  3G10[PD-L1] vhCDR1
DYGFS

SEQ ID NO: 3995 - protein, 17 aa, Artificial Sequence
  Description of Artificial Sequence: Synthetic peptide
  3G10[PD-L1] vhCDR2
WITAYNGNTNYAQKLQG

SEQ ID NO: 3996 - protein, 8 aa, Artificial Sequence
  Description of Artificial Sequence: Synthetic peptide
  3G10[PD-L1] vhCDR3
DYFYGMDV

SEQ ID NO: 3997 - protein, 107 aa, Artificial Sequence
  Description of Artificial Sequence: Synthetic polypeptide
  3G10[PD-L1] variable light Chain
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 3998 - protein, 11 aa, Artificial Sequence
  Description of Artificial Sequence: Synthetic peptide
  3G10[PD-L1] vlCDR1
RASQSVSSYLV

SEQ ID NO: 3999 - protein, 7 aa, Artificial Sequence
  Description of Artificial Sequence: Synthetic peptide
  3G10[PD-L1] vlCDR2
DASNRAT

SEQ ID NO: 4000 - protein, 9 aa, Artificial Sequence
  Description of Artificial Sequence: Synthetic peptide
  3G10[PD-L1] vlCDR3
QQRSNWPRT

SEQ ID NO: 4001 - protein, 118 aa, Artificial Sequence
  Description of Artificial Sequence: Synthetic polypeptide
  10A5[PD-L1] variable heavy Chain
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 4002 - protein, 5 aa, Artificial Sequence
  Description of Artificial Sequence: Synthetic peptide
  10A5[PD-L1] vhCDR1
SYDVH

SEQ ID NO: 4003 - protein, 17 aa, Artificial Sequence
  Description of Artificial Sequence: Synthetic peptide
  10A5[PD-L1] vhCDR2
WLHADTGITKFSQKFQG

SEQ ID NO: 4004 - protein, 9 aa, Artificial Sequence
  Description of Artificial Sequence: Synthetic peptide
  10A5[PD-L1] vhCDR3
ERIQLWFDY

SEQ ID NO: 4005 - protein, 107 aa, Artificial Sequence
  Description of Artificial Sequence: Synthetic polypeptide
  10A5[PD-L1] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 4006 - protein, 11 aa, Artificial Sequence
  Description of Artificial Sequence: Synthetic peptide
  10A5[PD-L1] vlCDR1
RASQGISSWLA

SEQ ID NO: 4007 - protein, 7 aa, Artificial Sequence
  Description of Artificial Sequence: Synthetic peptide
  10A5[PD-L1] vlCDR2
AASSLQS

SEQ ID NO: 4008 - protein, 9 aa, Artificial Sequence
  Description of Artificial Sequence: Synthetic peptide
  10A5[PD-L1] vlCDR3
QQYNSYPYT

SEQ ID NO: 4009 - protein, 114 aa, Artificial Sequence
  Description of Artificial Sequence: Synthetic polypeptide
  h3D10 Var 1[PD-L1] variable heavy Chain
QVQLVQSGAEVKKPGASVKVSCKASGYTFPDYYMNWVRQAPGQGLEWMGDIDPNYGGTNYAQKFQGRVTMTRDTSISTAYMELSRLRSDDTAVYYCARGALTDWGQGTMVTVSS

SEQ ID NO: 4010 - protein, 5 aa, Artificial Sequence
  Description of Artificial Sequence: Synthetic peptide
  h3D10 Var 1[PD-L1] vhCDR1
DYYMN

SEQ ID NO: 4011 - protein, 17 aa, Artificial Sequence
  Description of Artificial Sequence: Synthetic peptide
  h3D10 Var 1[PD-L1] vhCDR2
DIDPNYGGTNYAQKFQG

SEQ ID NO: 4012 - protein, 5 aa, Artificial Sequence
  Description of Artificial Sequence: Synthetic peptide
  h3D10 Var 1[PD-L1] vhCDR3
GALTD

SEQ ID NO: 4013 - protein, 106 aa, Artificial Sequence
  Description of Artificial Sequence: Synthetic polypeptide
  h3D10 Var 1[PD-L1] variable light Chain
EIVLTQSPATLSLSPGERATLSCRASSSVSYIYWFQQKPGQAPRLLIYAAFNRATGIPARFSGSGSGTDYTLTISSLEPEDFAVYYCQQWSNNPLTFGQGTKVEIK

SEQ ID NO: 4014 - protein, 10 aa, Artificial Sequence
  Description of Artificial Sequence: Synthetic peptide
  h3D10 Var 1[PD-L1] vlCDR1
RASSSVSYIY

SEQ ID NO: 4015 - protein, 7 aa, Artificial Sequence
  Description of Artificial Sequence: Synthetic peptide
  h3D10 Var 1[PD-L1] vlCDR2
AAFNRAT

SEQ ID NO: 4016 - protein, 9 aa, Artificial Sequence
  Description of Artificial Sequence: Synthetic peptide
  h3D10 Var 1[PD-L1] vlCDR3
QQWSNNPLT

SEQ ID NO: 4017 - protein, 114 aa, Artificial Sequence
  Description of Artificial Sequence: Synthetic polypeptide
  h3D10 Var 2[PD-L1] variable heavy Chain
QVQLVQSGAEVKKPGASVKVSCKASGYTFPDYYMNWVRQAPGQSLEWMGDIDPNYGGTNYNQKFQGRVTMTRDTSISTAYMELSRLRSDDTAVYYCARGALTDWGQGTMVTVSS

SEQ ID NO: 4018 - protein, 5 aa, Artificial Sequence
  Description of Artificial Sequence: Synthetic peptide
  h3D10 Var 2[PD-L1] vhCDR1
DYYMN

SEQ ID NO: 4019 - protein, 17 aa, Artificial Sequence
  Description of Artificial Sequence: Synthetic peptide
  h3D10 Var 2[PD-L1] vhCDR2
DIDPNYGGTNYNQKFQG

SEQ ID NO: 4020 - protein, 5 aa, Artificial Sequence
  Description of Artificial Sequence: Synthetic peptide
  h3D10 Var 2[PD-L1] vhCDR3
GALTD

SEQ ID NO: 4021 - protein, 106 aa, Artificial Sequence
  Description of Artificial Sequence: Synthetic polypeptide
  h3D10 Var 2[PD-L1] variable light Chain
EIVLTQSPATLSLSPGERATLSCRASSSVSYIYWFQQKPGQSPRPLIYAAFNRATGIPARFSGSGSGTDYTLTISSLEPEDFAVYYCQQWSNNPLTFGQGTKVEIK

SEQ ID NO: 4022 - protein, 10 aa, Artificial Sequence
  Description of Artificial Sequence: Synthetic peptide
  h3D10 Var 2[PD-L1] vlCDR1
RASSSVSYIY

SEQ ID NO: 4023 - protein, 7 aa, Artificial Sequence
  Description of Artificial Sequence: Synthetic peptide
  h3D10 Var 2[PD-L1] vlCDR2
AAFNRAT

SEQ ID NO: 4024 - protein, 9 aa, Artificial Sequence
  Description of Artificial Sequence: Synthetic peptide
  h3D10 Var 2[PD-L1] vlCDR3
QQWSNNPLT

SEQ ID NO: 4025 - protein, 114 aa, Artificial Sequence; identical to SEQ ID NO: 4017
  Description of Artificial Sequence: Synthetic polypeptide
  h3D10 Var 3[PD-L1] variable heavy Chain

SEQ ID NO: 4026 - protein, 5 aa, Artificial Sequence
  Description of Artificial Sequence: Synthetic peptide
  h3D10 Var 3[PD-L1] vhCDR1
DYYMN

SEQ ID NO: 4027 - protein, 17 aa, Artificial Sequence
  Description of Artificial Sequence: Synthetic peptide
  h3D10 Var 3[PD-L1] vhCDR2
DIDPNYGGTNYNQKFQG

SEQ ID NO: 4028 - protein, 5 aa, Artificial Sequence
  Description of Artificial Sequence: Synthetic peptide
  h3D10 Var 3[PD-L1] vhCDR3
GALTD

SEQ ID NO: 4029 - protein, 106 aa, Artificial Sequence
  Description of Artificial Sequence: Synthetic polypeptide
  h3D10 Var 3[PD-L1] variable light Chain
QIVLTQSPATLSLSPGERATLSCRASSSVSYIYWFQQKPGQSPRPLIYATFNLASGIPARFSGSGSGTSYTLTISRLEPEDFAVYYCQQWSNNPLTFGQGTKVEIK

SEQ ID NO: 4030 - protein, 10 aa, Artificial Sequence
  Description of Artificial Sequence: Synthetic peptide
  h3D10 Var 3[PD-L1] vlCDR1
RASSSVSYIY

SEQ ID NO: 4031 - protein, 7 aa, Artificial Sequence
  Description of Artificial Sequence: Synthetic peptide
  h3D10 Var 3[PD-L1] vlCDR2
ATFNLAS

SEQ ID NO: 4032 - protein, 9 aa, Artificial Sequence
  Description of Artificial Sequence: Synthetic peptide
  h3D10 Var 3[PD-L1] vlCDR3
QQWSNNPLT

SEQ ID NO: 4033 - protein, 114 aa, Artificial Sequence
  Description of Artificial Sequence: Synthetic polypeptide
  h3D10 Var 4[PD-L1] variable heavy Chain
EVQLVQSGAEVKKPGASVKVSCKASGYTFPDYYMNWVRQAPGQSLEWMGDIDPNYGGTNYNQKFQGRVTMTVDRSSSTAYMELSRLRSDDTAVYYCARGALTDWGQGTMVTVSS

SEQ ID NO: 4034 - protein, 5 aa, Artificial Sequence
  Description of Artificial Sequence: Synthetic peptide
  h3D10 Var 4[PD-L1] vhCDR1
DYYMN

SEQ ID NO: 4035 - protein, 17 aa, Artificial Sequence
  Description of Artificial Sequence: Synthetic peptide
  h3D10 Var 4[PD-L1] vhCDR2
DIDPNYGGTNYNQKFQG

SEQ ID NO: 4036 - protein, 5 aa, Artificial Sequence
  Description of Artificial Sequence: Synthetic peptide
  h3D10 Var 4[PD-L1] vhCDR3
GALTD

SEQ ID NO: 4037 - protein, 106 aa, Artificial Sequence; identical to SEQ ID NO: 4021
  Description of Artificial Sequence: Synthetic polypeptide
  h3D10 Var 4[PD-L1] variable light Chain

SEQ ID NO: 4038 - protein, 10 aa, Artificial Sequence
  Description of Artificial Sequence: Synthetic peptide
  h3D10 Var 4[PD-L1] vlCDR1
RASSSVSYIY

SEQ ID NO: 4039 - protein, 7 aa, Artificial Sequence
  Description of Artificial Sequence: Synthetic peptide
  h3D10 Var 4[PD-L1] vlCDR2
AAFNRAT

SEQ ID NO: 4040 - protein, 9 aa, Artificial Sequence
  Description of Artificial Sequence: Synthetic peptide
  h3D10 Var 4[PD-L1] vlCDR3
QQWSNNPLT

SEQ ID NO: 4041 - protein, 114 aa, Artificial Sequence; identical to SEQ ID NO: 4033
  Description of Artificial Sequence: Synthetic polypeptide
  h3D10 Var 5[PD-L1] variable heavy Chain

SEQ ID NO: 4042 - protein, 5 aa, Artificial Sequence
  Description of Artificial Sequence: Synthetic peptide
  h3D10 Var 5[PD-L1] vhCDR1
DYYMN

SEQ ID NO: 4043 - protein, 17 aa, Artificial Sequence
  Description of Artificial Sequence: Synthetic peptide
  h3D10 Var 5[PD-L1] vhCDR2
DIDPNYGGTNYNQKFQG

SEQ ID NO: 4044 - protein, 5 aa, Artificial Sequence
  Description of Artificial Sequence: Synthetic peptide
  h3D10 Var 5[PD-L1] vhCDR3
GALTD

SEQ ID NO: 4045 - protein, 106 aa, Artificial Sequence; identical to SEQ ID NO: 4029
  Description of Artificial Sequence: Synthetic polypeptide
  h3D10 Var 5[PD-L1] variable light Chain

SEQ ID NO: 4046 - protein, 10 aa, Artificial Sequence
  Description of Artificial Sequence: Synthetic peptide
  h3D10 Var 5[PD-L1] vlCDR1
RASSSVSYIY

SEQ ID NO: 4047 - protein, 7 aa, Artificial Sequence
  Description of Artificial Sequence: Synthetic peptide
  h3D10 Var 5[PD-L1] vlCDR2
ATFNLAS

SEQ ID NO: 4048 - protein, 9 aa, Artificial Sequence
  Description of Artificial Sequence: Synthetic peptide
  h3D10 Var 5[PD-L1] vlCDR3
QQWSNNPLT

SEQ ID NO: 4049 - protein, 114 aa, Artificial Sequence
  Description of Artificial Sequence: Synthetic polypeptide
  h3D10 Var 6[PD-L1] variable heavy Chain
EVQLVESGGGLVQPGRSLRLSCTASGYTFPDYYMNWVRQAPGKGLEWVGDIDPNYGGTTYAASVKGRFTISVDRSKSIAYLQMSSLKTEDTAVYYCTRGALTDWGQGTMVTVSS

SEQ ID NO: 4050 - protein, 5 aa, Artificial Sequence
  Description of Artificial Sequence: Synthetic peptide
  h3D10 Var 6[PD-L1] vhCDR1
DYYMN

SEQ ID NO: 4051 - protein, 17 aa, Artificial Sequence
  Description of Artificial Sequence: Synthetic peptide
  h3D10 Var 6[PD-L1] vhCDR2
DIDPNYGGTTYAASVKG

SEQ ID NO: 4052 - protein, 5 aa, Artificial Sequence
  Description of Artificial Sequence: Synthetic peptide
  h3D10 Var 6[PD-L1] vhCDR3
GALTD

SEQ ID NO: 4053 - protein, 106 aa, Artificial Sequence
  Description of Artificial Sequence: Synthetic polypeptide
  h3D10 Var 6[PD-L1] variable light Chain
DIQLTQSPSSLSASVGDRVTITCRASSGVSYIYWFQQKPGKAPKLLIYAAFNLASGVPSRFSGSGSGTEYTLTISSLQPEDFATYYCQQWSNNPLTFGQGTKVEIK

SEQ ID NO: 4054 - protein, 10 aa, Artificial Sequence
  Description of Artificial Sequence: Synthetic peptide
  h3D10 Var 6[PD-L1] vlCDR1
RASSGVSYIY

SEQ ID NO: 4055 - protein, 7 aa, Artificial Sequence
  Description of Artificial Sequence: Synthetic peptide
  h3D10 Var 6[PD-L1] vlCDR2
AAFNLAS

SEQ ID NO: 4056 - protein, 9 aa, Artificial Sequence
  Description of Artificial Sequence: Synthetic peptide
  h3D10 Var 6[PD-L1] vlCDR3
QQWSNNPLT

SEQ ID NO: 4057 - protein, 114 aa, Artificial Sequence
  Description of Artificial Sequence: Synthetic polypeptide
  h3D10 Var 7[PD-L1] variable heavy Chain
EVQLVESGGGLVQPGRSLRLSCTASGYTFPDYYMNWVRQAPGKGLEWVGDIDPNYGGTTYNASVKGRFTISVDRSKSIAYLQMSSLKTEDTAVYYCARGALTDWGQGTMVTVSS

SEQ ID NO: 4058 - protein, 5 aa, Artificial Sequence
  Description of Artificial Sequence: Synthetic peptide
  h3D10 Var 7[PD-L1] vhCDR1
DYYMN

SEQ ID NO: 4059 - protein, 17 aa, Artificial Sequence
  Description of Artificial Sequence: Synthetic peptide
  h3D10 Var 7[PD-L1] vhCDR2
DIDPNYGGTTYNASVKG

SEQ ID NO: 4060 - protein, 5 aa, Artificial Sequence
  Description of Artificial Sequence: Synthetic peptide
  h3D10 Var 7[PD-L1] vhCDR3
GALTD

SEQ ID NO: 4061 - protein, 106 aa, Artificial Sequence
  Description of Artificial Sequence: Synthetic polypeptide
  h3D10 Var 7[PD-L1] variable light Chain
DIQLTQSPSSLSASVGDRVTITCRASSGVSYIYWFQQKPGKAPKPLIYAAFNLASGVPSRFSGSGSGTEYTLTISSLQPEDFATYYCQQWSNNPLTFGQGTKVEIK

SEQ ID NO: 4062 - protein, 10 aa, Artificial Sequence
  Description of Artificial Sequence: Synthetic peptide
  h3D10 Var 7[PD-L1] vlCDR1
RASSGVSYIY

SEQ ID NO: 4063 - protein, 7 aa, Artificial Sequence
  Description of Artificial Sequence: Synthetic peptide
  h3D10 Var 7[PD-L1] vlCDR2
AAFNLAS

SEQ ID NO: 4064 - protein, 9 aa, Artificial Sequence
  Description of Artificial Sequence: Synthetic peptide
  h3D10 Var 7[PD-L1] vlCDR3
QQWSNNPLT

SEQ ID NO: 4065 - protein, 114 aa, Artificial Sequence; identical to SEQ ID NO: 4057
  Description of Artificial Sequence: Synthetic polypeptide
  h3D10 Var 8[PD-L1] variable heavy Chain

SEQ ID NO: 4066 - protein, 5 aa, Artificial Sequence
  Description of Artificial Sequence: Synthetic peptide
  h3D10 Var 8[PD-L1] vhCDR1
DYYMN

SEQ ID NO: 4067 - protein, 17 aa, Artificial Sequence
  Description of Artificial Sequence: Synthetic peptide
  h3D10 Var 8[PD-L1] vhCDR2
DIDPNYGGTTYNASVKG

SEQ ID NO: 4068 - protein, 5 aa, Artificial Sequence
  Description of Artificial Sequence: Synthetic peptide
  h3D10 Var 8[PD-L1] vhCDR3
GALTD

SEQ ID NO: 4069 - protein, 106 aa, Artificial Sequence
  Description of Artificial Sequence: Synthetic polypeptide
  h3D10 Var 8[PD-L1] variable light Chain
DIQLTQSPSILSASVGDRVTITCRASSSVSYIYWFQQKPGKAPKPLIYATFNLASGVPSRFSGSGSGTSYTLTISSLQPEDFATYYCQQWSNNPLTFGQGTKVEIK

SEQ ID NO: 4070 - protein, 10 aa, Artificial Sequence
  Description of Artificial Sequence: Synthetic peptide
  h3D10 Var 8[PD-L1] vlCDR1
RASSSVSYIY

SEQ ID NO: 4071 - protein, 7 aa, Artificial Sequence
  Description of Artificial Sequence: Synthetic peptide
  h3D10 Var 8[PD-L1] vlCDR2
ATFNLAS

SEQ ID NO: 4072 - protein, 9 aa, Artificial Sequence
  Description of Artificial Sequence: Synthetic peptide
  h3D10 Var 8[PD-L1] vlCDR3
QQWSNNPLT

SEQ ID NO: 4073 - protein, 114 aa, Artificial Sequence
  Description of Artificial Sequence: Synthetic polypeptide
  h3D10 Var 9[PD-L1] variable heavy Chain
EVQLVESGGGLVQPGRSLRLSCTASGYTFPDYYMNWVRQAPGKGLEWVGDIDPNYGGTTYNQSVKGRFTISVDRSKSIAYLQMSSLKTEDTAVYYCARGALTDWGQGTMVTVSS

SEQ ID NO: 4074 - protein, 5 aa, Artificial Sequence
  Description of Artificial Sequence: Synthetic peptide
  h3D10 Var 9[PD-L1] vhCDR1
DYYMN

SEQ ID NO: 4075 - protein, 17 aa, Artificial Sequence
  Description of Artificial Sequence: Synthetic peptide
  h3D10 Var 9[PD-L1] vhCDR2
DIDPNYGGTTYNQSVKG

SEQ ID NO: 4076 - protein, 5 aa, Artificial Sequence
  Description of Artificial Sequence: Synthetic peptide
  h3D10 Var 9[PD-L1] vhCDR3
GALTD

SEQ ID NO: 4077 - protein, 106 aa, Artificial Sequence; identical to SEQ ID NO: 4061
  Description of Artificial Sequence: Synthetic polypeptide
  h3D10 Var 9[PD-L1] variable light Chain

SEQ ID NO: 4078 - protein, 10 aa, Artificial Sequence
  Description of Artificial Sequence: Synthetic peptide
  h3D10 Var 9[PD-L1] vlCDR1
RASSGVSYIY

SEQ ID NO: 4079 - protein, 7 aa, Artificial Sequence
  Description of Artificial Sequence: Synthetic peptide
  h3D10 Var 9[PD-L1] vlCDR2
AAFNLAS

SEQ ID NO: 4080 - protein, 9 aa, Artificial Sequence
  Description of Artificial Sequence: Synthetic peptide
  h3D10 Var 9[PD-L1] vlCDR3
QQWSNNPLT

SEQ ID NO: 4081 - protein, 114 aa, Artificial Sequence; identical to SEQ ID NO: 4073
  Description of Artificial Sequence: Synthetic polypeptide
  h3D10 Var 10[PD-L1] variable heavy Chain

SEQ ID NO: 4082 - protein, 5 aa, Artificial Sequence
  Description of Artificial Sequence: Synthetic peptide
  h3D10 Var 10[PD-L1] vhCDR1
DYYMN

SEQ ID NO: 4083 - protein, 17 aa, Artificial Sequence
  Description of Artificial Sequence: Synthetic peptide
  h3D10 Var 10[PD-L1] vhCDR2
DIDPNYGGTTYNQSVKG

SEQ ID NO: 4084 - protein, 5 aa, Artificial Sequence
  Description of Artificial Sequence: Synthetic peptide
  h3D10 Var 10[PD-L1] vhCDR3
GALTD

SEQ ID NO: 4085 - protein, 106 aa, Artificial Sequence; identical to SEQ ID NO: 4069
  Description of Artificial Sequence: Synthetic polypeptide
  h3D10 Var 10[PD-L1] variable light Chain

SEQ ID NO: 4086 - protein, 10 aa, Artificial Sequence
  Description of Artificial Sequence: Synthetic peptide
  h3D10 Var 10[PD-L1] vlCDR1
RASSSVSYIY

SEQ ID NO: 4087 - protein, 7 aa, Artificial Sequence
  Description of Artificial Sequence: Synthetic peptide
  h3D10 Var 10[PD-L1] vlCDR2
ATFNLAS

SEQ ID NO: 4088 - protein, 9 aa, Artificial Sequence
  Description of Artificial Sequence: Synthetic peptide
  h3D10 Var 10[PD-L1] vlCDR3
QQWSNNPLT

SEQ ID NO: 4089 - protein, 114 aa, Artificial Sequence; identical to SEQ ID NO: 4049
  Description of Artificial Sequence: Synthetic polypeptide
  h3D10 Var 11[PD-L1] variable heavy Chain

SEQ ID NO: 4090 - protein, 5 aa, Artificial Sequence
  Description of Artificial Sequence: Synthetic peptide
  h3D10 Var 11[PD-L1] vhCDR1
DYYMN

SEQ ID NO: 4091 - protein, 17 aa, Artificial Sequence
  Description of Artificial Sequence: Synthetic peptide
  h3D10 Var 11[PD-L1] vhCDR2
DIDPNYGGTTYAASVKG

SEQ ID NO: 4092 - protein, 5 aa, Artificial Sequence
  Description of Artificial Sequence: Synthetic peptide
  h3D10 Var 11[PD-L1] vhCDR3
GALTD

SEQ ID NO: 4093 - protein, 106 aa, Artificial Sequence; identical to SEQ ID NO: 4013
  Description of Artificial Sequence: Synthetic polypeptide
  h3D10 Var 11[PD-L1] variable light Chain

SEQ ID NO: 4094 - protein, 10 aa, Artificial Sequence
  Description of Artificial Sequence: Synthetic peptide
  h3D10 Var 11[PD-L1] vlCDR1
RASSSVSYIY

SEQ ID NO: 4095 - protein, 7 aa, Artificial Sequence
  Description of Artificial Sequence: Synthetic peptide
  h3D10 Var 11[PD-L1] vlCDR2
AAFNRAT

SEQ ID NO: 4096 - protein, 9 aa, Artificial Sequence
  Description of Artificial Sequence: Synthetic peptide
  h3D10 Var 11[PD-L1] vlCDR3
QQWSNNPLT

SEQ ID NO: 4097 - protein, 114 aa, Artificial Sequence; identical to SEQ ID NO: 4009
  Description of Artificial Sequence: Synthetic polypeptide
  h3D10 Var 12[PD-L1] variable heavy Chain

SEQ ID NO: 4098 - protein, 5 aa, Artificial Sequence
  Description of Artificial Sequence: Synthetic peptide
  h3D10 Var 12[PD-L1] vhCDR1
DYYMN

SEQ ID NO: 4099 - protein, 17 aa, Artificial Sequence
  Description of Artificial Sequence: Synthetic peptide
  h3D10 Var 12[PD-L1] vhCDR2
DIDPNYGGTNYAQKFQG

SEQ ID NO: 4100 - protein, 5 aa, Artificial Sequence
  Description of Artificial Sequence: Synthetic peptide
  h3D10 Var 12[PD-L1] vhCDR3
GALTD

SEQ ID NO: 4101 - protein, 106 aa, Artificial Sequence; identical to SEQ ID NO: 4053
  Description of Artificial Sequence: Synthetic polypeptide
  h3D10 Var 12[PD-L1] variable light Chain

SEQ ID NO: 4102 - protein, 10 aa, Artificial Sequence
  Description of Artificial Sequence: Synthetic peptide
  h3D10 Var 12[PD-L1] vlCDR1
RASSGVSYIY

SEQ ID NO: 4103 - protein, 7 aa, Artificial Sequence
  Description of Artificial Sequence: Synthetic peptide
  h3D10 Var 12[PD-L1] vlCDR2
AAFNLAS

SEQ ID NO: 4104 - protein, 9 aa, Artificial Sequence
  Description of Artificial Sequence: Synthetic peptide
  h3D10 Var 12[PD-L1] vlCDR3
QQWSNNPLT

SEQ ID NO: 4105 - protein, 114 aa, Artificial Sequence; identical to SEQ ID NO: 4073
  Description of Artificial Sequence: Synthetic polypeptide
  h3D10 Var 13[PD-L1] variable heavy Chain

SEQ ID NO: 4106 - protein, 5 aa, Artificial Sequence
  Description of Artificial Sequence: Synthetic peptide
  h3D10 Var 13[PD-L1] vhCDR1
DYYMN

SEQ ID NO: 4107 - protein, 17 aa, Artificial Sequence
  Description of Artificial Sequence: Synthetic peptide
  h3D10 Var 13[PD-L1] vhCDR2
DIDPNYGGTTYNQSVKG

SEQ ID NO: 4108 - protein, 5 aa, Artificial Sequence
  Description of Artificial Sequence: Synthetic peptide
  h3D10 Var 13[PD-L1] vhCDR3
GALTD

SEQ ID NO: 4109 - protein, 106 aa, Artificial Sequence; identical to SEQ ID NO: 4029
  Description of Artificial Sequence: Synthetic polypeptide
  h3D10 Var 13[PD-L1] variable light Chain

SEQ ID NO: 4110 - protein, 10 aa, Artificial Sequence
  Description of Artificial Sequence: Synthetic peptide
  h3D10 Var 13[PD-L1] vlCDR1
RASSSVSYIY

SEQ ID NO: 4111 - protein, 7 aa, Artificial Sequence
  Description of Artificial Sequence: Synthetic peptide
  h3D10 Var 13[PD-L1] vlCDR2
ATFNLAS

SEQ ID NO: 4112 - protein, 9 aa, Artificial Sequence
  Description of Artificial Sequence: Synthetic peptide
  h3D10 Var 13[PD-L1] vlCDR3
QQWSNNPLT

SEQ ID NO: 4113 - protein, 114 aa, Artificial Sequence; identical to SEQ ID NO: 4033
  Description of Artificial Sequence: Synthetic polypeptide
  h3D10 Var 14[PD-L1] variable heavy Chain

SEQ ID NO: 4114 - protein, 5 aa, Artificial Sequence
  Description of Artificial Sequence: Synthetic peptide
  h3D10 Var 14[PD-L1] vhCDR1
DYYMN

SEQ ID NO: 4115 - protein, 17 aa, Artificial Sequence
  Description of Artificial Sequence: Synthetic peptide
  h3D10 Var 14[PD-L1] vhCDR2
DIDPNYGGTNYNQKFQG

SEQ ID NO: 4116 - protein, 5 aa, Artificial Sequence
  Description of Artificial Sequence: Synthetic peptide
  h3D10 Var 14[PD-L1] vhCDR3
GALTD

SEQ ID NO: 4117 - protein, 106 aa, Artificial Sequence; identical to SEQ ID NO: 4069
  Description of Artificial Sequence: Synthetic polypeptide
  h3D10 Var 14[PD-L1] variable light Chain

SEQ ID NO: 4118 - protein, 10 aa, Artificial Sequence
  Description of Artificial Sequence: Synthetic peptide
  h3D10 Var 14[PD-L1] vlCDR1
RASSSVSYIY

SEQ ID NO: 4119 - protein, 7 aa, Artificial Sequence
  Description of Artificial Sequence: Synthetic peptide
  h3D10 Var 14[PD-L1] vlCDR2
ATFNLAS

SEQ ID NO: 4120 - protein, 9 aa, Artificial Sequence
  Description of Artificial Sequence: Synthetic peptide
  h3D10 Var 14[PD-L1] vlCDR3
QQWSNNPLT

SEQ ID NO: 4121 - protein, 123 aa, Artificial Sequence
  Description of Artificial Sequence: Synthetic polypeptide
  Antibody A[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSPDYSPYYYYGMDVWGQGTTVTVSS

SEQ ID NO: 4122 - protein, 5 aa, Artificial Sequence
  Description of Artificial Sequence: Synthetic peptide
  Antibody A[PD-L1] vhCDR1
SYAIS

SEQ ID NO: 4123 - protein, 17 aa, Artificial Sequence
  Description of Artificial Sequence: Synthetic peptide
  Antibody A[PD-L1] vhCDR2
GIIPIFGTANYAQKFQG

SEQ ID NO: 4124 - protein, 14 aa, Artificial Sequence
  Description of Artificial Sequence: Synthetic peptide
  Antibody A[PD-L1] vhCDR3
SPDYSPYYYYGMDV

SEQ ID NO: 4125 - protein, 111 aa, Artificial Sequence
  Description of Artificial Sequence: Synthetic polypeptide
  Antibody A[PD-L1] variable light Chain
QSVLTQPPSASGTPGQRVTISCSGSSSNIGSNTVNWYQQLPGTAPKLLIYGNSNRPSGVPDRFSGSKSGTSASLAISGLQSEDEADYYCQSYDSSLSGSVFGGGIKLTVLG

SEQ ID NO: 4126 - protein, 13 aa, Artificial Sequence
  Description of Artificial Sequence: Synthetic peptide
  Antibody A[PD-L1] vlCDR1
SGSSSNIGSNTVN

SEQ ID NO: 4127 - protein, 7 aa, Artificial Sequence
  Description of Artificial Sequence: Synthetic peptide
  Antibody A[PD-L1] vlCDR2
GNSNRPS

SEQ ID NO: 4128 - protein, 11 aa, Artificial Sequence
  Description of Artificial Sequence: Synthetic peptide
  Antibody A[PD-L1] vlCDR3
QSYDSSLSGSV

SEQ ID NO: 4129 - protein, 116 aa, Artificial Sequence
  Description of Artificial Sequence: Synthetic polypeptide
  C5H9v2[PD-L1] variable heavy Chain
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 4130 - protein, 5 aa, Artificial Sequence
  Description of Artificial Sequence: Synthetic peptide
  C5H9v2[PD-L1] vhCDR1
SYAMS

SEQ ID NO: 4131 - protein, 17 aa, Artificial Sequence
  Description of Artificial Sequence: Synthetic peptide
  C5H9v2[PD-L1] vhCDR2
SIWRNGIVTVYADSVKG

SEQ ID NO: 4132 - protein, 7 aa, Artificial Sequence
  Description of Artificial Sequence: Synthetic peptide
  C5H9v2[PD-L1] vhCDR3
WSAAFDY

SEQ ID NO: 4133 - protein, 107 aa, Artificial Sequence
  Description of Artificial Sequence: Synthetic polypeptide
  C5H9v2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIK

SEQ ID NO: 4134 - protein, 11 aa, Artificial Sequence
  Description of Artificial Sequence: Synthetic peptide
  C5H9v2[PD-L1] vlCDR1
RASQSISSYLN

SEQ ID NO: 4135 - protein, 7 aa, Artificial Sequence
  Description of Artificial Sequence: Synthetic peptide
  C5H9v2[PD-L1] vlCDR2
AASSLQS

SEQ ID NO: 4136 - protein, 9 aa, Artificial Sequence
  Description of Artificial Sequence: Synthetic peptide
  C5H9v2[PD-L1] vlCDR3
QQDNGYPST

SEQ ID NO: 4137 - protein, 115 aa, Artificial Sequence
  Description of Artificial Sequence: Synthetic polypeptide
  humanized 29E.2A3[PD-L1] variable heavy Chain
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 4138 - protein, 5 aa, Artificial Sequence
  Description of Artificial Sequence: Synthetic peptide
  humanized 29E.2A3[PD-L1] vhCDR1
SYVMH

SEQ ID NO: 4139 - protein, 17 aa, Artificial Sequence
  Description of Artificial Sequence: Synthetic peptide
  humanized 29E.2A3[PD-L1] vhCDR2
YVNPFNDGTKYNEMFKG

SEQ ID NO: 4140 - protein, 6 aa, Artificial Sequence
  Description of Artificial Sequence: Synthetic peptide
  humanized 29E.2A3[PD-L1] vhCDR3
QAWGYP

SEQ ID NO: 4141 - protein, 111 aa, Artificial Sequence
  Description of Artificial Sequence: Synthetic polypeptide
  humanized 29E.2A3[PD-L1] variable light Chain
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 4142 - protein, 15 aa, Artificial Sequence
  Description of Artificial Sequence: Synthetic peptide
  humanized 29E.2A3[PD-L1] vlCDR1
RATESVEYYGTSLVQ

SEQ ID NO: 4143 - protein, 7 aa, Artificial Sequence
  Description of Artificial Sequence: Synthetic peptide
  humanized 29E.2A3[PD-L1] vlCDR2
AASSVDS

SEQ ID NO: 4144 - protein, 9 aa, Artificial Sequence
  Description of Artificial Sequence: Synthetic peptide
  humanized 29E.2A3[PD-L1] vlCDR3
QQSRRVPYT

SEQ ID NO: 4145 - protein, 121 aa, Artificial Sequence
  Description of Artificial Sequence: Synthetic polypeptide
  1B9[PD-L1] variable heavy Chain
DVQLQESGPGLVKPSQSLSLTCTVTGYSITSDHAWNWIRQVPGNKLEWMGYITYRGSTTYSPSLKSRISITRDTSKNQFFLQLNSVTTEDTATYYCARSMITTGYYVMDYWGQGTSVTVSS

SEQ ID NO: 4146 - protein, 6 aa, Artificial Sequence
  Description of Artificial Sequence: Synthetic peptide
  1B9[PD-L1] vhCDR1
SDHAWN

SEQ ID NO: 4147 - protein, 16 aa, Artificial Sequence
  Description of Artificial Sequence: Synthetic peptide
  1B9[PD-L1] vhCDR2
YITYRGSTTYSPSLKS

SEQ ID NO: 4148 - protein, 12 aa, Artificial Sequence
  Description of Artificial Sequence: Synthetic peptide
  1B9[PD-L1] vhCDR3
SMITTGYYVMDY

SEQ ID NO: 4149 - protein, 107 aa, Artificial Sequence
  Description of Artificial Sequence: Synthetic polypeptide
  1B9[PD-L1] variable light Chain
DIVMTQSHKFMSTSLGDRVTITCKASQDVGISVVWYQQKPGQSPKLLIYWASTRHTGVPDRFTGSGSGTDFTLTINNVQSEDLADYFCQQYSSYPLTVGAGTKLELK

SEQ ID NO: 4150 - protein, 11 aa, Artificial Sequence
  Description of Artificial Sequence: Synthetic peptide
  1B9[PD-L1] vlCDR1
KASQDVGISVV

SEQ ID NO: 4151 - protein, 7 aa, Artificial Sequence
  Description of Artificial Sequence: Synthetic peptide
  1B9[PD-L1] vlCDR2
WASTRHT

SEQ ID NO: 4152 - protein, 9 aa, Artificial Sequence
  Description of Artificial Sequence: Synthetic peptide
  1B9[PD-L1] vlCDR3
QQYSSYPLT

SEQ ID NO: 4153 - protein, 121 aa, Artificial Sequence
  Description of Artificial Sequence: Synthetic polypeptide
  4H1[PD-L1] variable heavy Chain
DVQLQESGPGLVKPSQSLSLTCTVTDYSITSDYAWTWIRQFPGNKLEWMGYITYRGTTRYNPSLTSRISFTRDTSKNQLFLQLNSVTTEDTGTYCCARSMITTGYYAMDYWGQGTSVTVSS

SEQ ID NO: 4154 - protein, 6 aa, Artificial Sequence
  Description of Artificial Sequence: Synthetic peptide
  4H1[PD-L1] vhCDR1
SDYAWT

SEQ ID NO: 4155 - protein, 16 aa, Artificial Sequence
  Description of Artificial Sequence: Synthetic peptide
  4H1[PD-L1] vhCDR2
YITYRGTTRYNPSLTS

SEQ ID NO: 4156 - protein, 12 aa, Artificial Sequence
  Description of Artificial Sequence: Synthetic peptide
  4H1[PD-L1] vhCDR3
SMITTGYYAMDY

SEQ ID NO: 4157 - protein, 107 aa, Artificial Sequence
  Description of Artificial Sequence: Synthetic polypeptide
  4H1[PD-L1] variable light Chain
DIVMTQSHKFMSTSVGDRVSISCKASQDVGISVAWYQQKPGQSPKLLIYWASTRHTGVPVRFTGSGSGTDFTLTISNVQSEDLADYFCQQYSSYPPTFGAGTKLELK

SEQ ID NO: 4158 - protein, 11 aa, Artificial Sequence
  Description of Artificial Sequence: Synthetic peptide
  4H1[PD-L1] vlCDR1
KASQDVGISVA

SEQ ID NO: 4159 - protein, 7 aa, Artificial Sequence
  Description of Artificial Sequence: Synthetic peptide
  4H1[PD-L1] vlCDR2
WASTRHT

SEQ ID NO: 4160 - protein, 9 aa, Artificial Sequence
  Description of Artificial Sequence: Synthetic peptide
  4H1[PD-L1] vlCDR3
QQYSSYPPT

SEQ ID NO: 4161 - protein, 120 aa, Artificial Sequence
  Description of Artificial Sequence: Synthetic polypeptide
  mAb-42[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 4162 - protein, 5 aa, Artificial Sequence
  Description of Artificial Sequence: Synthetic peptide
  mAb-42[PD-L1] vhCDR1
SYAIS

SEQ ID NO: 4163 - protein, 17 aa, Artificial Sequence
  Description of Artificial Sequence: Synthetic peptide
  mAb-42[PD-L1] vhCDR2
GIIPIFGTANYAQKFQG

SEQ ID NO: 4164 - protein, 11 aa, Artificial Sequence
  Description of Artificial Sequence: Synthetic peptide
  mAb-42[PD-L1] vhCDR3
GRQMFGAGIDF

SEQ ID NO: 4165 - protein, 112 aa, Artificial Sequence
  Description of Artificial Sequence: Synthetic polypeptide
  mAb-42[PD-L1] variable light Chain
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 4166 - protein, 13 aa, Artificial Sequence
  Description of Artificial Sequence: Synthetic peptide
  mAb-42[PD-L1] vlCDR1
TRSSGSIDSNYVQ

SEQ ID NO: 4167 - protein, 7 aa, Artificial Sequence
  Description of Artificial Sequence: Synthetic peptide
  mAb-42[PD-L1] vlCDR2
EDNQRPS

SEQ ID NO: 4168 - protein, 11 aa, Artificial Sequence
  Description of Artificial Sequence: Synthetic peptide
  mAb-42[PD-L1] vlCDR3
QSYDSNNRHVI

SEQ ID NO: 4169 - protein, 120 aa, Artificial Sequence
  Description of Artificial Sequence: Synthetic polypeptide
  BAP058-03[PD-L1] variable heavy Chain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 4170 - protein, 5 aa, Artificial Sequence
  Description of Artificial Sequence: Synthetic peptide
  BAP058-03[PD-L1] vhCDR1
SYWMY

SEQ ID NO: 4171 - protein, 17 aa, Artificial Sequence
  Description of Artificial Sequence: Synthetic peptide
  BAP058-03[PD-L1] vhCDR2
RIDPNSGSTKYNEKFKN

SEQ ID NO: 4172 - protein, 11 aa, Artificial Sequence
  Description of Artificial Sequence: Synthetic peptide
  BAP058-03[PD-L1] vhCDR3
DYRKGLYAMDY

SEQ ID NO: 4173 - protein, 107 aa, Artificial Sequence
  Description of Artificial Sequence: Synthetic polypeptide
  BAP058-03[PD-L1] variable light Chain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 4174 - protein, 11 aa, Artificial Sequence
  Description of Artificial Sequence: Synthetic peptide
  BAP058-03[PD-L1] vlCDR1
KASQDVGTAVA

SEQ ID NO: 4175 - protein, 7 aa, Artificial Sequence
  Description of Artificial Sequence: Synthetic peptide
  BAP058-03[PD-L1] vlCDR2
WASTRHT

SEQ ID NO: 4176 - protein, 9 aa, Artificial Sequence
  Description of Artificial Sequence: Synthetic peptide
  BAP058-03[PD-L1] vlCDR3
QQYNSYPLT

SEQ ID NO: 4177 - protein, 120 aa, Artificial Sequence
  Description of Artificial Sequence: Synthetic polypeptide
  BAP058-04[PD-L1] variable heavy Chain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 4178 - protein, 5 aa, Artificial Sequence
  Description of Artificial Sequence: Synthetic peptide
  BAP058-04[PD-L1] vhCDR1
SYWMY

SEQ ID NO: 4179 - protein, 17 aa, Artificial Sequence
  Description of Artificial Sequence: Synthetic peptide
  BAP058-04[PD-L1] vhCDR2
RIDPNSGSTKYNEKFKN

SEQ ID NO: 4180 - protein, 11 aa, Artificial Sequence
  Description of Artificial Sequence: Synthetic peptide
  BAP058-04[PD-L1] vhCDR3
DYRKGLYAMDY

SEQ ID NO: 4181 - protein, 107 aa, Artificial Sequence
  Description of Artificial Sequence: Synthetic polypeptide
  BAP058-04[PD-L1] variable light Chain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 4182 - protein, 11 aa, Artificial Sequence
  Description of Artificial Sequence: Synthetic peptide
  BAP058-04[PD-L1] vlCDR1
KASQDVGTAVA

SEQ ID NO: 4183 - protein, 7 aa, Artificial Sequence
  Description of Artificial Sequence: Synthetic peptide
  BAP058-04[PD-L1] vlCDR2
WASTRHT

SEQ ID NO: 4184 - protein, 9 aa, Artificial Sequence
  Description of Artificial Sequence: Synthetic peptide
  BAP058-04[PD-L1] vlCDR3
QQYNSYPLT

SEQ ID NO: 4185 - protein, 120 aa, Artificial Sequence
  Description of Artificial Sequence: Synthetic polypeptide
  BAP058-06[PD-L1] variable heavy Chain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 4186 - protein, 5 aa, Artificial Sequence
  Description of Artificial Sequence: Synthetic peptide
  BAP058-06[PD-L1] vhCDR1
SYWMY

SEQ ID NO: 4187 - protein, 17 aa, Artificial Sequence
  Description of Artificial Sequence: Synthetic peptide
  BAP058-06[PD-L1] vhCDR2
RIDPNSGSTKYNEKFKN

SEQ ID NO: 4188 - protein, 11 aa, Artificial Sequence
  Description of Artificial Sequence: Synthetic peptide
  BAP058-06[PD-L1] vhCDR3
DYRKGLYAMDY

SEQ ID NO: 4189 - protein, 107 aa, Artificial Sequence; identical to SEQ ID NO: 4181
  Description of Artificial Sequence: Synthetic polypeptide
  BAP058-06[PD-L1] variable light Chain

SEQ ID NO: 4190 - protein, 11 aa, Artificial Sequence
  Description of Artificial Sequence: Synthetic peptide
  BAP058-06[PD-L1] vlCDR1
KASQDVGTAVA

SEQ ID NO: 4191 - protein, 7 aa, Artificial Sequence
  Description of Artificial Sequence: Synthetic peptide
  BAP058-06[PD-L1] vlCDR2
WASTRHT

SEQ ID NO: 4192 - protein, 9 aa, Artificial Sequence
  Description of Artificial Sequence: Synthetic peptide
  BAP058-06[PD-L1] vlCDR3
QQYNSYPLT

SEQ ID NO: 4193 - protein, 120 aa, Artificial Sequence
  Description of Artificial Sequence: Synthetic polypeptide
  BAP058-07[PD-L1] variable heavy Chain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 4194 - protein, 5 aa, Artificial Sequence
  Description of Artificial Sequence: Synthetic peptide
  BAP058-07[PD-L1] vhCDR1
SYWMY

SEQ ID NO: 4195 - protein, 17 aa, Artificial Sequence
  Description of Artificial Sequence: Synthetic peptide
  BAP058-07[PD-L1] vhCDR2
RIDPNSGSTKYNEKFKN

SEQ ID NO: 4196 - protein, 11 aa, Artificial Sequence
  Description of Artificial Sequence: Synthetic peptide
  BAP058-07[PD-L1] vhCDR3
DYRKGLYAMDY

SEQ ID NO: 4197 - protein, 107 aa, Artificial Sequence
  Description of Artificial Sequence: Synthetic polypeptide
  BAP058-07[PD-L1] variable light Chain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 4198 - protein, 11 aa, Artificial Sequence
  Description of Artificial Sequence: Synthetic peptide
  BAP058-07[PD-L1] vlCDR1
KASQDVGTAVA

SEQ ID NO: 4199 - protein, 7 aa, Artificial Sequence
  Description of Artificial Sequence: Synthetic peptide
  BAP058-07[PD-L1] vlCDR2
WASTRHT

SEQ ID NO: 4200 - protein, 9 aa, Artificial Sequence
  Description of Artificial Sequence: Synthetic peptide
  BAP058-07[PD-L1] vlCDR3
QQYNSYPLT

SEQ ID NO: 4201 - protein, 120 aa, Artificial Sequence; identical to SEQ ID NO: 4169
  Description of Artificial Sequence: Synthetic polypeptide
  BAP058-11[PD-L1] variable heavy Chain

SEQ ID NO: 4202 - protein, 5 aa, Artificial Sequence
  Description of Artificial Sequence: Synthetic peptide
  BAP058-11[PD-L1] vhCDR1
SYWMY

SEQ ID NO: 4203 - protein, 17 aa, Artificial Sequence
  Description of Artificial Sequence: Synthetic peptide
  BAP058-11[PD-L1] vhCDR2
RIDPNSGSTKYNEKFKN

SEQ ID NO: 4204 - protein, 11 aa, Artificial Sequence
  Description of Artificial Sequence: Synthetic peptide
  BAP058-11[PD-L1] vhCDR3
DYRKGLYAMDY

SEQ ID NO: 4205 - protein, 107 aa, Artificial Sequence
  Description of Artificial Sequence: Synthetic polypeptide
  BAP058-11[PD-L1] variable light Chain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 4206 - protein, 11 aa, Artificial Sequence
  Description of Artificial Sequence: Synthetic peptide
  BAP058-11[PD-L1] vlCDR1
KASQDVGTAVA

SEQ ID NO: 4207 - protein, 7 aa, Artificial Sequence
  Description of Artificial Sequence: Synthetic peptide
  BAP058-11[PD-L1] vlCDR2
WASTRHT

SEQ ID NO: 4208 - protein, 9 aa, Artificial Sequence
  Description of Artificial Sequence: Synthetic peptide
  BAP058-11[PD-L1] vlCDR3
QQYNSYPLT

SEQ ID NO: 4209 - protein, 120 aa, Artificial Sequence
  Description of Artificial Sequence: Synthetic polypeptide
  BAP058-13[PD-L1] variable heavy Chain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 4210 - protein, 5 aa, Artificial Sequence
  Description of Artificial Sequence: Synthetic peptide
  BAP058-13[PD-L1] vhCDR1
SYWMY

SEQ ID NO: 4211 - protein, 17 aa, Artificial Sequence
  Description of Artificial Sequence: Synthetic peptide
  BAP058-13[PD-L1] vhCDR2
RIDPNSGSTKYNEKFKN

SEQ ID NO: 4212 - protein, 11 aa, Artificial Sequence
  Description of Artificial Sequence: Synthetic peptide
  BAP058-13[PD-L1] vhCDR3
DYRKGLYAMDY

SEQ ID NO: 4213 - protein, 107 aa, Artificial Sequence
  Description of Artificial Sequence: Synthetic polypeptide
  BAP058-13[PD-L1] variable light Chain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 4214 - protein, 11 aa, Artificial Sequence
  Description of Artificial Sequence: Synthetic peptide
  BAP058-13[PD-L1] vlCDR1
KASQDVGTAVA

SEQ ID NO: 4215 - protein, 7 aa, Artificial Sequence
  Description of Artificial Sequence: Synthetic peptide
  BAP058-13[PD-L1] vlCDR2
WASTRHT

SEQ ID NO: 4216 - protein, 9 aa, Artificial Sequence
  Description of Artificial Sequence: Synthetic peptide
  BAP058-13[PD-L1] vlCDR3
QQYNSYPLT

SEQ ID NO: 4217 - protein, 121 aa, Artificial Sequence
  Description of Artificial Sequence: Synthetic polypeptide
  H6[PD-L1] variable heavy Chain
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNIVATITPLDYWGQGTLVTVSS

SEQ ID NO: 4218 - protein, 5 aa, Artificial Sequence
  Description of Artificial Sequence: Synthetic peptide
  H6[PD-L1] vhCDR1
SYAIS

SEQ ID NO: 4219 - protein, 17 aa, Artificial Sequence
  Description of Artificial Sequence: Synthetic peptide
  H6[PD-L1] vhCDR2
GIIPIFGTANYAQKFQG

SEQ ID NO: 4220 - protein, 12 aa, Artificial Sequence
  Description of Artificial Sequence: Synthetic peptide
  H6[PD-L1] vhCDR3
GNIVATITPLDY

SEQ ID NO: 4221 - protein, 108 aa, Artificial Sequence
  Description of Artificial Sequence: Synthetic polypeptide
  H6[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCQVWDSSSDHRIFGGGTKLTVL

SEQ ID NO: 4222 - protein, 11 aa, Artificial Sequence
  Description of Artificial Sequence: Synthetic peptide
  H6[PD-L1] vlCDR1
GGENIGRKTVH

SEQ ID NO: 4223 - protein, 7 aa, Artificial Sequence
  Description of Artificial Sequence: Synthetic peptide
  H6[PD-L1] vlCDR2
YDSDRPS

SEQ ID NO: 4224 - protein, 11 aa, Artificial Sequence
  Description of Artificial Sequence: Synthetic peptide
  H6[PD-L1] vlCDR3
QVWDSSSDHRI

SEQ ID NO: 4225 - protein, 121 aa, Artificial Sequence
  Description of Artificial Sequence: Synthetic polypeptide
  RC5[PD-L1] variable heavy Chain
EVQLLESGGGVVQPGGSLRLSCAASGFTFSSYWMSWVRQAPGKGLEWVANIKQDGSEKYYVDSVKGRFTISRDNSKNTVSLQMNSLRAEDTAVYYCAKDRYYNFPLGMDVWGQGTTVTVSS

SEQ ID NO: 4226 - protein, 5 aa, Artificial Sequence
  Description of Artificial Sequence: Synthetic peptide
  RC5[PD-L1] vhCDR1
SYWMS

SEQ ID NO: 4227 - protein, 17 aa, Artificial Sequence
  Description of Artificial Sequence: Synthetic peptide
  RC5[PD-L1] vhCDR2
NIKQDGSEKYYVDSVKG

SEQ ID NO: 4228 - protein, 12 aa, Artificial Sequence
  Description of Artificial Sequence: Synthetic peptide
  RC5[PD-L1] vhCDR3
DRYYNFPLGMDV

SEQ ID NO: 4229 - protein, 107 aa, Artificial Sequence
  Description of Artificial Sequence: Synthetic polypeptide
  RC5[PD-L1] variable light Chain
AIRMTQSPSSLSASVGDRVTITCRASQSISSYLNWYQQKPGKAPKLLIYTTSSLKSGVPSRFSGSGSGTDFTLTISRLQPEDFATYYCQQSYSSTWTFGRGTKVEIK

SEQ ID NO: 4230 - protein, 11 aa, Artificial Sequence
  Description of Artificial Sequence: Synthetic peptide
  RC5[PD-L1] vlCDR1
RASQSISSYLN

SEQ ID NO: 4231 - protein, 7 aa, Artificial Sequence
  Description of Artificial Sequence: Synthetic peptide
  RC5[PD-L1] vlCDR2
TTSSLKS

SEQ ID NO: 4232 - protein, 9 aa, Artificial Sequence
  Description of Artificial Sequence: Synthetic peptide
  RC5[PD-L1] vlCDR3
QQSYSSTWT

SEQ ID NO: 4233 - protein, 123 aa, Artificial Sequence
  Description of Artificial Sequence: Synthetic polypeptide
  SH1A1Q[PD-L1] variable heavy Chain
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTIYDSSGYSFDYWGQGTLVTVSS

SEQ ID NO: 4234 - protein, 5 aa, Artificial Sequence
  Description of Artificial Sequence: Synthetic peptide
  SH1A1Q[PD-L1] vhCDR1
SYAIS

SEQ ID NO: 4235 - protein, 17 aa, Artificial Sequence
  Description of Artificial Sequence: Synthetic peptide
  SH1A1Q[PD-L1] vhCDR2
GIIPIFGTANYAQKFQG

SEQ ID NO: 4236 - protein, 14 aa, Artificial Sequence
  Description of Artificial Sequence: Synthetic peptide
  SH1A1Q[PD-L1] vhCDR3
EGTIYDSSGYSFDY

SEQ ID NO: 4237 - protein, 110 aa, Artificial Sequence
  Description of Artificial Sequence: Synthetic polypeptide
  SH1A1Q[PD-L1] variable light Chain
QSVLTQPPSVSAAPGQKVTISCSGNNSNIANNYVSWYQQLPGTAPKLLIYDNNYRPSGIPDRFSGSKSGTSATLDITGLQTGDEADYYCGVWDGSLTTGVFGGGTKLTVL

SEQ ID NO: 4238 - protein, 13 aa, Artificial Sequence
  Description of Artificial Sequence: Synthetic peptide
  SH1A1Q[PD-L1] vlCDR1
SGNNSNIANNYVS

SEQ ID NO: 4239 - protein, 7 aa, Artificial Sequence
  Description of Artificial Sequence: Synthetic peptide
  SH1A1Q[PD-L1] vlCDR2
DNNYRPS

SEQ ID NO: 4240 - protein, 11 aa, Artificial Sequence
  Description of Artificial Sequence: Synthetic peptide
  SH1A1Q[PD-L1] vlCDR3
GVWDGSLTTGV

SEQ ID NO: 4241 - protein, 118 aa, Artificial Sequence
  Description of Artificial Sequence: Synthetic polypeptide
  SH1B3[PD-L1] variable heavy Chain
QVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 4242 - protein, 5 aa, Artificial Sequence
  Description of Artificial Sequence: Synthetic peptide
  SH1B3[PD-L1] vhCDR1
SYAMH

SEQ ID NO: 4243 - protein, 17 aa, Artificial Sequence
  Description of Artificial Sequence: Synthetic peptide
  SH1B3[PD-L1] vhCDR2
VISFDGSNKYYADSVRG

SEQ ID NO: 4244 - protein, 9 aa, Artificial Sequence
  Description of Artificial Sequence: Synthetic peptide
  SH1B3[PD-L1] vhCDR3
GWLDRDIDY

SEQ ID NO: 4245 - protein, 110 aa, Artificial Sequence
  Description of Artificial Sequence: Synthetic polypeptide
  SH1B3[PD-L1] variable light Chain
LPVLTQPASVSGSPGQSITISCTGTTSDIGGYDYVSWYQQHPGKAPKLMIYDVSKRPSGVSNRFSGSKSGNTASLTISGLQAEDEADYYCSSYTSSSTHVFGTGTKLTVL

SEQ ID NO: 4246 - protein, 14 aa, Artificial Sequence
  Description of Artificial Sequence: Synthetic peptide
  SH1B3[PD-L1] vlCDR1
TGTTSDIGGYDYVS

SEQ ID NO: 4247 - protein, 7 aa, Artificial Sequence
  Description of Artificial Sequence: Synthetic peptide
  SH1B3[PD-L1] vlCDR2
DVSKRPS

SEQ ID NO: 4248 - protein, 10 aa, Artificial Sequence
  Description of Artificial Sequence: Synthetic peptide
  SH1B3[PD-L1] vlCDR3
SSYTSSSTHV

SEQ ID NO: 4249 - protein, 118 aa, Artificial Sequence
  Description of Artificial Sequence: Synthetic polypeptide
  SH1D1[PD-L1] variable heavy Chain
EVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 4250 - protein, 5 aa, Artificial Sequence
  Description of Artificial Sequence: Synthetic peptide
  SH1D1[PD-L1] vhCDR1
SYAMH

SEQ ID NO: 4251 - protein, 17 aa, Artificial Sequence
  Description of Artificial Sequence: Synthetic peptide
  SH1D1[PD-L1] vhCDR2
VISFDGSNKYYADSVRG

SEQ ID NO: 4252 - protein, 9 aa, Artificial Sequence
  Description of Artificial Sequence: Synthetic peptide
  SH1D1[PD-L1] vhCDR3
GWLDRDIDY

SEQ ID NO: 4253 - protein, 111 aa, Artificial Sequence
  Description of Artificial Sequence: Synthetic polypeptide
  SH1D1[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYRSSTLGPVFGGGTKLTVL

SEQ ID NO: 4254 - protein, 14 aa, Artificial Sequence
  Description of Artificial Sequence: Synthetic peptide
  SH1D1[PD-L1] vlCDR1
TGTSSDVGGYNYVS

SEQ ID NO: 4255 - protein, 7 aa, Artificial Sequence
  Description of Artificial Sequence: Synthetic peptide
  SH1D1[PD-L1] vlCDR2
DVSNRPS

SEQ ID NO: 4256 - protein, 11 aa, Artificial Sequence
  Description of Artificial Sequence: Synthetic peptide
  SH1D1[PD-L1] vlCDR3
SSYRSSTLGPV

SEQ ID NO: 4257 - protein, 118 aa, Artificial Sequence; identical to SEQ ID NO: 4241
  Description of Artificial Sequence: Synthetic polypeptide
  SH1D2[PD-L1] variable heavy Chain

SEQ ID NO: 4258 - protein, 5 aa, Artificial Sequence
  Description of Artificial Sequence: Synthetic peptide
  SH1D2[PD-L1] vhCDR1
SYAMH

SEQ ID NO: 4259 - protein, 17 aa, Artificial Sequence
  Description of Artificial Sequence: Synthetic peptide
  SH1D2[PD-L1] vhCDR2
VISFDGSNKYYADSVRG

SEQ ID NO: 4260 - protein, 9 aa, Artificial Sequence
  Description of Artificial Sequence: Synthetic peptide
  SH1D2[PD-L1] vhCDR3
GWLDRDIDY

SEQ ID NO: 4261 - protein, 110 aa, Artificial Sequence
  Description of Artificial Sequence: Synthetic polypeptide
  SH1D2[PD-L1] variable light Chain
QAGLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGYVFGTGTKLTVL

SEQ ID NO: 4262 - protein, 13 aa, Artificial Sequence
  Description of Artificial Sequence: Synthetic peptide
  SH1D2[PD-L1] vlCDR1
SGSSSNIGNNAVN

SEQ ID NO: 4263 - protein, 7 aa, Artificial Sequence
  Description of Artificial Sequence: Synthetic peptide
  SH1D2[PD-L1] vlCDR2
YDDLLPS

SEQ ID NO: 4264 - protein, 11 aa, Artificial Sequence
  Description of Artificial Sequence: Synthetic peptide
  SH1D2[PD-L1] vlCDR3
AAWDDSLNGYV

SEQ ID NO: 4265 - protein, 118 aa, Artificial Sequence; identical to SEQ ID NO: 4249
  Description of Artificial Sequence: Synthetic polypeptide
  SH1D12[PD-L1] variable heavy Chain

SEQ ID NO: 4266 - protein, 5 aa, Artificial Sequence
  Description of Artificial Sequence: Synthetic peptide
  SH1D12[PD-L1] vhCDR1
SYAMH

SEQ ID NO: 4267 - protein, 17 aa, Artificial Sequence
  Description of Artificial Sequence: Synthetic peptide
  SH1D12[PD-L1] vhCDR2
VISFDGSNKYYADSVRG

SEQ ID NO: 4268 - protein, 9 aa, Artificial Sequence
  Description of Artificial Sequence: Synthetic peptide
  SH1D12[PD-L1] vhCDR3
GWLDRDIDY

SEQ ID NO: 4269 - protein, 110 aa, Artificial Sequence
  Description of Artificial Sequence: Synthetic polypeptide
  SH1D12[PD-L1] variable light Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSTTHVFGTGTKVTVL

SEQ ID NO: 4270 - protein, 14 aa, Artificial Sequence
  Description of Artificial Sequence: Synthetic peptide
  SH1D12[PD-L1] vlCDR1
TGTSSDVGGYNYVS

SEQ ID NO: 4271 - protein, 7 aa, Artificial Sequence
  Description of Artificial Sequence: Synthetic peptide
  SH1D12[PD-L1] vlCDR2
DVSKRPS

SEQ ID NO: 4272 - protein, 10 aa, Artificial Sequence
  Description of Artificial Sequence: Synthetic peptide
  SH1D12[PD-L1] vlCDR3
SSYTSSTTHV

SEQ ID NO: 4273 - protein, 118 aa, Artificial Sequence; identical to SEQ ID NO: 4249
  Description of Artificial Sequence: Synthetic polypeptide
  SH1E1[PD-L1] variable heavy Chain

SEQ ID NO: 4274 - protein, 5 aa, Artificial Sequence
  Description of Artificial Sequence: Synthetic peptide
  SH1E1[PD-L1] vhCDR1
SYAMH

SEQ ID NO: 4275 - protein, 17 aa, Artificial Sequence
  Description of Artificial Sequence: Synthetic peptide
  SH1E1[PD-L1] vhCDR2
VISFDGSNKYYADSVRG

SEQ ID NO: 4276 - protein, 9 aa, Artificial Sequence
  Description of Artificial Sequence: Synthetic peptide
  SH1E1[PD-L1] vhCDR3
GWLDRDIDY

SEQ ID NO: 4277 - protein, 110 aa, Artificial Sequence
  Description of Artificial Sequence: Synthetic polypeptide
  SH1E1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVWVFGGGTQLTVL

SEQ ID NO: 4278 - protein, 13 aa, Artificial Sequence
  Description of Artificial Sequence: Synthetic peptide
  SH1E1[PD-L1] vlCDR1
SGSSSNIGNNYVS

SEQ ID NO: 4279 - protein, 7 aa, Artificial Sequence
  Description of Artificial Sequence: Synthetic peptide
  SH1E1[PD-L1] vlCDR2
DNNKRPS

SEQ ID NO: 4280 - protein, 11 aa, Artificial Sequence
  Description of Artificial Sequence: Synthetic peptide
  SH1E1[PD-L1] vlCDR3
GTWDSSLSVWV

SEQ ID NO: 4281 - protein, 118 aa, Artificial Sequence; identical to SEQ ID NO: 4241
  Description of Artificial Sequence: Synthetic polypeptide
  SH1G9[PD-L1] variable heavy Chain

SEQ ID NO: 4282 - protein, 5 aa, Artificial Sequence
  Description of Artificial Sequence: Synthetic peptide
  SH1G9[PD-L1] vhCDR1
SYAMH

SEQ ID NO: 4283 - protein, 17 aa, Artificial Sequence
  Description of Artificial Sequence: Synthetic peptide
  SH1G9[PD-L1] vhCDR2
VISFDGSNKYYADSVRG

SEQ ID NO: 4284 - protein, 9 aa, Artificial Sequence
  Description of Artificial Sequence: Synthetic peptide
  SH1G9[PD-L1] vhCDR3
GWLDRDIDY

SEQ ID NO: 4285 - protein, 112 aa, Artificial Sequence
  Description of Artificial Sequence: Synthetic polypeptide
  SH1G9[PD-L1] variable light Chain
QSVLTQPASVSGSPGQSITISCTGTSSDVGGYNYVSWYQQHPGRAPRLMIYDVSNRPSGVSNRFSGSKSGNTASLTISGLQAEDEGDYYCSSYTSGGTLGPVFGGGTKLTVL

SEQ ID NO: 4286 - protein, 14 aa, Artificial Sequence
  Description of Artificial Sequence: Synthetic peptide
  SH1G9[PD-L1] vlCDR1
TGTSSDVGGYNYVS

SEQ ID NO: 4287 - protein, 7 aa, Artificial Sequence
  Description of Artificial Sequence: Synthetic peptide
  SH1G9[PD-L1] vlCDR2
DVSNRPS

SEQ ID NO: 4288 - protein, 12 aa, Artificial Sequence
  Description of Artificial Sequence: Synthetic peptide
  SH1G9[PD-L1] vlCDR3
SSYTSGGTLGPV

SEQ ID NO: 4289 - protein, 120 aa, Artificial Sequence
  Description of Artificial Sequence: Synthetic polypeptide
  SH1E6[PD-L1] variable heavy Chain
QVQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 4290 - protein, 5 aa, Artificial Sequence
  Description of Artificial Sequence: Synthetic peptide
  SH1E6[PD-L1] vhCDR1
RYGVH

SEQ ID NO: 4291 - protein, 17 aa, Artificial Sequence
  Description of Artificial Sequence: Synthetic peptide
  SH1E6[PD-L1] vhCDR2
RLIPIVSMTNYAQKFQD

SEQ ID NO: 4292 - protein, 11 aa, Artificial Sequence
  Description of Artificial Sequence: Synthetic peptide
  SH1E6[PD-L1] vhCDR3
VGQQLPWVFFA

SEQ ID NO: 4293 - protein, 110 aa, Artificial Sequence
  Description of Artificial Sequence: Synthetic polypeptide
  SH1E6[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 4294 - protein, 13 aa, Artificial Sequence
  Description of Artificial Sequence: Synthetic peptide
  SH1E6[PD-L1] vlCDR1
SGSSSNIGNNYVS

SEQ ID NO: 4295 - protein, 7 aa, Artificial Sequence
  Description of Artificial Sequence: Synthetic peptide
  SH1E6[PD-L1] vlCDR2
DNNKRPS

SEQ ID NO: 4296 - protein, 11 aa, Artificial Sequence
  Description of Artificial Sequence: Synthetic peptide
  SH1E6[PD-L1] vlCDR3
GTWDSSLSAVV

SEQ ID NO: 4297 - protein, 118 aa, Artificial Sequence
  Description of Artificial Sequence: Synthetic polypeptide
  SH1A2[PD-L1] variable heavy Chain
QMQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 4298 - protein, 5 aa, Artificial Sequence
  Description of Artificial Sequence: Synthetic peptide
  SH1A2[PD-L1] vhCDR1
SYAMH

SEQ ID NO: 4299 - protein, 17 aa, Artificial Sequence
  Description of Artificial Sequence: Synthetic peptide
  SH1A2[PD-L1] vhCDR2
VISFDGSNKYYADSVRG

SEQ ID NO: 4300 - protein, 9 aa, Artificial Sequence
  Description of Artificial Sequence: Synthetic peptide
  SH1A2[PD-L1] vhCDR3
GWLDRDIDY

SEQ ID NO: 4301 - protein, 110 aa, Artificial Sequence
  Description of Artificial Sequence: Synthetic polypeptide
  SH1A2[PD-L1] variable light Chain
QSVVTQPPSVSAAPGQKVTISCSGSSSNIGNNYVSWYQQVPGTAPKLLIYDNNKRPSGIPDRFSGSNSDTSATLGITGLQTGDEADYYCGTWDSSLSAWVFGGGTKLTVL

SEQ ID NO: 4302 - protein, 13 aa, Artificial Sequence
  Description of Artificial Sequence: Synthetic peptide
  SH1A2[PD-L1] vlCDR1
SGSSSNIGNNYVS

SEQ ID NO: 4303 - protein, 7 aa, Artificial Sequence
  Description of Artificial Sequence: Synthetic peptide
  SH1A2[PD-L1] vlCDR2
DNNKRPS

SEQ ID NO: 4304 - protein, 11 aa, Artificial Sequence
  Description of Artificial Sequence: Synthetic peptide
  SH1A2[PD-L1] vlCDR3
GTWDSSLSAWV

SEQ ID NO: 4305 - protein, 118 aa, Artificial Sequence
  Description of Artificial Sequence: Synthetic polypeptide
  SH1B1[PD-L1] variable heavy Chain
QVQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 4306 - protein, 5 aa, Artificial Sequence
  Description of Artificial Sequence: Synthetic peptide
  SH1B1[PD-L1] vhCDR1
SYAMH

SEQ ID NO: 4307 - protein, 17 aa, Artificial Sequence
  Description of Artificial Sequence: Synthetic peptide
  SH1B1[PD-L1] vhCDR2
VISFDGSNKYYADSVRG

SEQ ID NO: 4308 - protein, 9 aa, Artificial Sequence
  Description of Artificial Sequence: Synthetic peptide
  SH1B1[PD-L1] vhCDR3
GWLDRDIDY

SEQ ID NO: 4309 - protein, 112 aa, Artificial Sequence
  Description of Artificial Sequence: Synthetic polypeptide
  SH1B1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSVVFGGGTKLTVL

SEQ ID NO: 4310 - protein, 13 aa, Artificial Sequence
  Description of Artificial Sequence: Synthetic peptide
  SH1B1[PD-L1] vlCDR1
SGSSSNIGNNYVS

SEQ ID NO: 4311 - protein, 7 aa, Artificial Sequence
  Description of Artificial Sequence: Synthetic peptide
  SH1B1[PD-L1] vlCDR2
DNNKRPS

SEQ ID NO: 4312 - protein, 13 aa, Artificial Sequence
  Description of Artificial Sequence: Synthetic peptide
  SH1B1[PD-L1] vlCDR3
GTWDSSLSAGSVV

SEQ ID NO: 4313 - protein, 121 aa, Artificial Sequence
  Description of Artificial Sequence: Synthetic polypeptide
  H6B1L[PD-L1] variable heavy Chain
QMQLVQSGAEVKKPGSSVKVSCKASGGTFSSYAYSWVRQAPGQGLEWMGGIIPSFGTANYAQKFQGRVTITADESTSTAYMELSSLRSEDTAVYYCARGPIVATITPLDYWGQGTLVTVSS

SEQ ID NO: 4314 - protein, 5 aa, Artificial Sequence
  Description of Artificial Sequence: Synthetic peptide
  H6B1L[PD-L1] vhCDR1
SYAYS

SEQ ID NO: 4315 - protein, 17 aa, Artificial Sequence
  Description of Artificial Sequence: Synthetic peptide
  H6B1L[PD-L1] vhCDR2
GIIPSFGTANYAQKFQG

SEQ ID NO: 4316 - protein, 12 aa, Artificial Sequence
  Description of Artificial Sequence: Synthetic peptide
  H6B1L[PD-L1] vhCDR3
GPIVATITPLDY

SEQ ID NO: 4317 - protein, 108 aa, Artificial Sequence
  Description of Artificial Sequence: Synthetic polypeptide
  H6B1L[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCLVWDSSSDHRIFGGGTKLTVL

SEQ ID NO: 4318 - protein, 11 aa, Artificial Sequence
  Description of Artificial Sequence: Synthetic peptide
  H6B1L[PD-L1] vlCDR1
GGENIGRKTVH

SEQ ID NO: 4319 - protein, 7 aa, Artificial Sequence
  Description of Artificial Sequence: Synthetic peptide
  H6B1L[PD-L1] vlCDR2
YDSDRPS

SEQ ID NO: 4320 - protein, 11 aa, Artificial Sequence
  Description of Artificial Sequence: Synthetic peptide
  H6B1L[PD-L1] vlCDR3
LVWDSSSDHRI

SEQ ID NO: 4321 - protein, 121 aa, Artificial Sequence
  Description of Artificial Sequence: Synthetic polypeptide
  H6A1[PD-L1] variable heavy Chain
QMQLVQSGAEVKKPGSSVKVSCKASGGTFSSYAYSWVRQAPGQGLEWMGGIIPIFGTANYAQKFQGRVTITADESTSTAYMELSSLRSEDTAVYYCARGPIVATITPLDYWGQGTLVTVSS

SEQ ID NO: 4322 - protein, 5 aa, Artificial Sequence
  Description of Artificial Sequence: Synthetic peptide
  H6A1[PD-L1] vhCDR1
SYAYS

SEQ ID NO: 4323 - protein, 17 aa, Artificial Sequence
  Description of Artificial Sequence: Synthetic peptide
  H6A1[PD-L1] vhCDR2
GIIPIFGTANYAQKFQG

SEQ ID NO: 4324 - protein, 12 aa, Artificial Sequence
  Description of Artificial Sequence: Synthetic peptide
  H6A1[PD-L1] vhCDR3
GPIVATITPLDY

SEQ ID NO: 4325 - protein, 108 aa, Artificial Sequence; identical to SEQ ID NO: 4221
  Description of Artificial Sequence: Synthetic polypeptide
  H6A1[PD-L1] variable light Chain

SEQ ID NO: 4326 - protein, 11 aa, Artificial Sequence
  Description of Artificial Sequence: Synthetic peptide
  H6A1[PD-L1] vlCDR1
GGENIGRKTVH

SEQ ID NO: 4327 - protein, 7 aa, Artificial Sequence
  Description of Artificial Sequence: Synthetic peptide
  H6A1[PD-L1] vlCDR2
YDSDRPS

SEQ ID NO: 4328 - protein, 11 aa, Artificial Sequence
  Description of Artificial Sequence: Synthetic peptide
  H6A1[PD-L1] vlCDR3
QVWDSSSDHRI

SEQ ID NO: 4329 - protein, 121 aa, Artificial Sequence; identical to SEQ ID NO: 4313
  Description of Artificial Sequence: Synthetic polypeptide
  H6B1[PD-L1] variable heavy Chain

SEQ ID NO: 4330 - protein, 5 aa, Artificial Sequence
  Description of Artificial Sequence: Synthetic peptide
  H6B1[PD-L1] vhCDR1
SYAYS

SEQ ID NO: 4331 - protein, 17 aa, Artificial Sequence
  Description of Artificial Sequence: Synthetic peptide
  H6B1[PD-L1] vhCDR2
GIIPSFGTANYAQKFQG

SEQ ID NO: 4332 - protein, 12 aa, Artificial Sequence
  Description of Artificial Sequence: Synthetic peptide
  H6B1[PD-L1] vhCDR3
GPIVATITPLDY

SEQ ID NO: 4333 - protein, 108 aa, Artificial Sequence; identical to SEQ ID NO: 4221
  Description of Artificial Sequence: Synthetic polypeptide
  H6B1[PD-L1] variable light Chain

SEQ ID NO: 4334 - protein, 11 aa, Artificial Sequence
  Description of Artificial Sequence: Synthetic peptide
  H6B1[PD-L1] vlCDR1
GGENIGRKTVH

SEQ ID NO: 4335 - protein, 7 aa, Artificial Sequence
  Description of Artificial Sequence: Synthetic peptide
  H6B1[PD-L1] vlCDR2
YDSDRPS

SEQ ID NO: 4336 - protein, 11 aa, Artificial Sequence
  Description of Artificial Sequence: Synthetic peptide
  H6B1[PD-L1] vlCDR3
QVWDSSSDHRI

SEQ ID NO: 4337 - protein, 121 aa, Artificial Sequence
  Description of Artificial Sequence: Synthetic polypeptide
  H6B2[PD-L1] variable heavy Chain
QMQLVQSGAEVKKPGSSVKVSCKASGGTFSSYAISWVRQAPGQGLEWMGGIIPAFGTANYAQKFQGRVTITADESTSTAYMELSSLRSEDTAVYYCARGPIVATITPLDYWGQGTLVTVSS

SEQ ID NO: 4338 - protein, 5 aa, Artificial Sequence
  Description of Artificial Sequence: Synthetic peptide
  H6B2[PD-L1] vhCDR1
SYAIS

SEQ ID NO: 4339 - protein, 17 aa, Artificial Sequence
  Description of Artificial Sequence: Synthetic peptide
  H6B2[PD-L1] vhCDR2
GIIPAFGTANYAQKFQG

SEQ ID NO: 4340 - protein, 12 aa, Artificial Sequence
  Description of Artificial Sequence: Synthetic peptide
  H6B2[PD-L1] vhCDR3
GPIVATITPLDY

SEQ ID NO: 4341 - protein, 108 aa, Artificial Sequence; identical to SEQ ID NO: 4221
  Description of Artificial Sequence: Synthetic polypeptide
  H6B2[PD-L1] variable light Chain

SEQ ID NO: 4342 - protein, 11 aa, Artificial Sequence
  Description of Artificial Sequence: Synthetic peptide
  H6B2[PD-L1] vlCDR1
GGENIGRKTVH

SEQ ID NO: 4343 - protein, 7 aa, Artificial Sequence
  Description of Artificial Sequence: Synthetic peptide
  H6B2[PD-L1] vlCDR2
YDSDRPS

SEQ ID NO: 4344 - protein, 11 aa, Artificial Sequence
  Description of Artificial Sequence: Synthetic peptide
  H6B2[PD-L1] vlCDR3
QVWDSSSDHRI

SEQ ID NO: 4345 - protein, 118 aa, Artificial Sequence
  Description of Artificial Sequence: Synthetic polypeptide
  G12[PD-L1] variable heavy Chain
EVQLVQSGAEVKKPGASVKVSCKASGYTFTGYYMHWVRQAPGQGLEWMGWINPNSDNTGSAQKFQGRVFMTKTTSLNTAYMELSGLRSEDTAIYYCARERSSGYFDFWGQGTLVTVSS

SEQ ID NO: 4346 - protein, 5 aa, Artificial Sequence
  Description of Artificial Sequence: Synthetic peptide
  G12[PD-L1] vhCDR1
GYYMH

SEQ ID NO: 4347 - protein, 17 aa, Artificial Sequence
  Description of Artificial Sequence: Synthetic peptide
  G12[PD-L1] vhCDR2
WINPNSDNTGSAQKFQG

SEQ ID NO: 4348 - protein, 9 aa, Artificial Sequence
  Description of Artificial Sequence: Synthetic peptide
  G12[PD-L1] vhCDR3
ERSSGYFDF

SEQ ID NO: 4349 - protein, 107 aa, Artificial Sequence
  Description of Artificial Sequence: Synthetic polypeptide
  G12[PD-L1] variable light Chain
DIVMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 4350 - protein, 11 aa, Artificial Sequence
  Description of Artificial Sequence: Synthetic peptide
  G12[PD-L1] vlCDR1
RASQSISSYLN

SEQ ID NO: 4351 - protein, 7 aa, Artificial Sequence
  Description of Artificial Sequence: Synthetic peptide
  G12[PD-L1] vlCDR2
AASSLQS

SEQ ID NO: 4352 - protein, 9 aa, Artificial Sequence
  Description of Artificial Sequence: Synthetic peptide
  G12[PD-L1] vlCDR3
QQSYSTPIT

SEQ ID NO: 4353 - protein, 118 aa, Artificial Sequence
  Description of Artificial Sequence: Synthetic polypeptide
  RSA1[PD-L1] variable heavy Chain
EVQLVQSGGGLVQPGGSLRLSCAASGFTFSSYSMNWVRQAPGKGLEWVSYISSSSSTIYYADSVKGRFTISRDNAKNSLYLQMNSLRDEDTAVYYCARGDYYYGMDVWGQGTTVTVSS

SEQ ID NO: 4354 - protein, 5 aa, Artificial Sequence
  Description of Artificial Sequence: Synthetic peptide
  RSA1[PD-L1] vhCDR1
SYSMN

SEQ ID NO: 4355 - protein, 17 aa, Artificial Sequence
  Description of Artificial Sequence: Synthetic peptide
  RSA1[PD-L1] vhCDR2
YISSSSSTIYYADSVKG

SEQ ID NO: 4356 - protein, 9 aa, Artificial Sequence
  Description of Artificial Sequence: Synthetic peptide
  RSA1[PD-L1] vhCDR3
GDYYYGMDV

SEQ ID NO: 4357 - protein, 108 aa, Artificial Sequence
  Description of Artificial Sequence: Synthetic polypeptide
  RSA1[PD-L1] variable light Chain
NIQMTQSPSSVSASVGDRVTITCRASQDISRWLAWYQQKPGKAPKLLIYAASSLQSGVPSRFSGSGSGTDFALTISSLQPEDFATYYCQQADSFFSITFGQGTRLEIK

SEQ ID NO: 4358 - protein, 11 aa, Artificial Sequence
  Description of Artificial Sequence: Synthetic peptide
  RSA1[PD-L1] vlCDR1
RASQDISRWLA

SEQ ID NO: 4359 - protein, 7 aa, Artificial Sequence
  Description of Artificial Sequence: Synthetic peptide
  RSA1[PD-L1] vlCDR2
AASSLQS

SEQ ID NO: 4360 - protein, 10 aa, Artificial Sequence
  Description of Artificial Sequence: Synthetic peptide
  RSA1[PD-L1] vlCDR3
QQADSFFSIT

SEQ ID NO: 4361 - protein, 120 aa, Artificial Sequence
  Description of Artificial Sequence: Synthetic polypeptide
  RA3[PD-L1] variable heavy Chain
QMQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 4362 - protein, 5 aa, Artificial Sequence
  Description of Artificial Sequence: Synthetic peptide
  RA3[PD-L1] vhCDR1
RYGVH

SEQ ID NO: 4363 - protein, 17 aa, Artificial Sequence
  Description of Artificial Sequence: Synthetic peptide
  RA3[PD-L1] vhCDR2
RLIPIVSMTNYAQKFQD

SEQ ID NO: 4364 - protein, 11 aa, Artificial Sequence
  Description of Artificial Sequence: Synthetic peptide
  RA3[PD-L1] vhCDR3
VGQQLPWVFFA

SEQ ID NO: 4365 - protein, 107 aa, Artificial Sequence
  Description of Artificial Sequence: Synthetic polypeptide
  RA3[PD-L1] variable light Chain
DIQMTQSPSSLSASVGDRVTITCQASQDISNYLNWYQQKPGKAPKLLIYDASTLQSGVPSRFSGSGSGTDFTLTISSLQPEDFATYYCQQSYSSHWTFGQGTKVEIK

SEQ ID NO: 4366 - protein, 11 aa, Artificial Sequence
  Description of Artificial Sequence: Synthetic peptide
  RA3[PD-L1] vlCDR1
QASQDISNYLN

SEQ ID NO: 4367 - protein, 7 aa, Artificial Sequence
  Description of Artificial Sequence: Synthetic peptide
  RA3[PD-L1] vlCDR2
DASTLQS

SEQ ID NO: 4368 - protein, 9 aa, Artificial Sequence
  Description of Artificial Sequence: Synthetic peptide
  RA3[PD-L1] vlCDR3
QQSYSSHWT

SEQ ID NO: 4369 - protein, 119 aa, Artificial Sequence
  Description of Artificial Sequence: Synthetic polypeptide
  SH1E2[PD-L1] variable heavy Chain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 4370 - protein, 5 aa, Artificial Sequence
  Description of Artificial Sequence: Synthetic peptide
  SH1E2[PD-L1] vhCDR1
SYAIS

SEQ ID NO: 4371 - protein, 17 aa, Artificial Sequence
  Description of Artificial Sequence: Synthetic peptide
  SH1E2[PD-L1] vhCDR2
GIIPIFGTANYAQKFQG

SEQ ID NO: 4372 - protein, 10 aa, Artificial Sequence
  Description of Artificial Sequence: Synthetic peptide
  SH1E2[PD-L1] vhCDR3
APYYYYYMDV

SEQ ID NO: 4373 - protein, 109 aa, Artificial Sequence
  Description of Artificial Sequence: Synthetic polypeptide
  SH1E2[PD-L1] variable light Chain
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 4374 - protein, 14 aa, Artificial Sequence
  Description of Artificial Sequence: Synthetic peptide
  SH1E2[PD-L1] vlCDR1
TGSSSDVGSYNLVS

SEQ ID NO: 4375 - protein, 6 aa, Artificial Sequence
  Description of Artificial Sequence: Synthetic peptide
  SH1E2[PD-L1] vlCDR2
DVSKRS

SEQ ID NO: 4376 - protein, 10 aa, Artificial Sequence
  Description of Artificial Sequence: Synthetic peptide
  SH1E2[PD-L1] vlCDR3
SSYTGISTVV

SEQ ID NO: 4377 - protein, 120 aa, Artificial Sequence; identical to SEQ ID NO: 4289
  Description of Artificial Sequence: Synthetic polypeptide
  SH1E4[PD-L1] variable heavy Chain

SEQ ID NO: 4378 - protein, 5 aa, Artificial Sequence
  Description of Artificial Sequence: Synthetic peptide
  SH1E4[PD-L1] vhCDR1
RYGVH

SEQ ID NO: 4379 - protein, 17 aa, Artificial Sequence
  Description of Artificial Sequence: Synthetic peptide
  SH1E4[PD-L1] vhCDR2
RLIPIVSMTNYAQKFQD

SEQ ID NO: 4380 - protein, 11 aa, Artificial Sequence
  Description of Artificial Sequence: Synthetic peptide
  SH1E4[PD-L1] vhCDR3
VGQQLPWVFFA

SEQ ID NO: 4381 - protein, 112 aa, Artificial Sequence
  Description of Artificial Sequence: Synthetic polypeptide
  SH1E4[PD-L1] variable light Chain
QSVLTQPPSASGSPGQSVTISCTGTSSDIGGYDSVSWYQQHPGKAPKLMIYDVSKRPSGVSNRFSGSKSGNTASLTISGLQAEDEADYYCSSYTSSSIFFYVFGTGTKVTVL

SEQ ID NO: 4382 - protein, 14 aa, Artificial Sequence
  Description of Artificial Sequence: Synthetic peptide
  SH1E4[PD-L1] vlCDR1
TGTSSDIGGYDSVS

SEQ ID NO: 4383 - protein, 7 aa, Artificial Sequence
  Description of Artificial Sequence: Synthetic peptide
  SH1E4[PD-L1] vlCDR2
DVSKRPS

SEQ ID NO: 4384 - protein, 12 aa, Artificial Sequence
  Description of Artificial Sequence: Synthetic peptide
  SH1E4[PD-L1] vlCDR3
SSYTSSSIFFYV

SEQ ID NO: 4385 - protein, 121 aa, Artificial Sequence
  Description of Artificial Sequence: Synthetic polypeptide
  SH1B11[PD-L1] variable heavy Chain
QVQLVQSGSELKKPGSSVKVSCKASGYSFSGYYIHWVRQAPGQGLEWMGWIDPNSGVTNYVRRFQGRVTMTRDTSLSTAYMELSGLTADDTAVYYCARDENLWQFGYLDYWGQGTLVTVSS

SEQ ID NO: 4386 - protein, 5 aa, Artificial Sequence
  Description of Artificial Sequence: Synthetic peptide
  SH1B11[PD-L1] vhCDR1
GYYIH

SEQ ID NO: 4387 - protein, 17 aa, Artificial Sequence
  Description of Artificial Sequence: Synthetic peptide
  SH1B11[PD-L1] vhCDR2
WIDPNSGVTNYVRRFQG

SEQ ID NO: 4388 - protein, 12 aa, Artificial Sequence
  Description of Artificial Sequence: Synthetic peptide
  SH1B11[PD-L1] vhCDR3
DENLWQFGYLDY

SEQ ID NO: 4389 - protein, 107 aa, Artificial Sequence
  Description of Artificial Sequence: Synthetic polypeptide
  SH1B11[PD-L1] variable light Chain
DIVMTQSPSSLSASIGDRVTITCRASQRISAYVNWYQQKPGKAPKVLIYAASSLRSGVPSRFSGSGSGTDFTLTISSLQPEDFATYYCQQTYSSPWTFGQGTKVEIK

SEQ ID NO: 4390 - protein, 11 aa, Artificial Sequence
  Description of Artificial Sequence: Synthetic peptide
  SH1B11[PD-L1] vlCDR1
RASQRISAYVN

SEQ ID NO: 4391 - protein, 7 aa, Artificial Sequence
  Description of Artificial Sequence: Synthetic peptide
  SH1B11[PD-L1] vlCDR2
AASSLRS

SEQ ID NO: 4392 - protein, 9 aa, Artificial Sequence
  Description of Artificial Sequence: Synthetic peptide
  SH1B11[PD-L1] vlCDR3
QQTYSSPWT

SEQ ID NO: 4393 - protein, 119 aa, Artificial Sequence
  Description of Artificial Sequence: Synthetic polypeptide
  SH1C8[PD-L1] variable heavy Chain
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQWLVTELDYWGQGTLVTVSS

SEQ ID NO: 4394 - protein, 5 aa, Artificial Sequence
  Description of Artificial Sequence: Synthetic peptide
  SH1C8[PD-L1] vhCDR1
SYAMH

SEQ ID NO: 4395 - protein, 17 aa, Artificial Sequence
  Description of Artificial Sequence: Synthetic peptide
  SH1C8[PD-L1] vhCDR2
VISYDGSNKYYADSVKG

SEQ ID NO: 4396 - protein, 10 aa, Artificial Sequence
  Description of Artificial Sequence: Synthetic peptide
  SH1C8[PD-L1] vhCDR3
GQWLVTELDY

SEQ ID NO: 4397 - protein, 111 aa, Artificial Sequence
  Description of Artificial Sequence: Synthetic polypeptide
  SH1C8[PD-L1] variable light Chain
QSVVTQPPSVSAAPGQKVTISCSGSSSDIGNHYVSWYQQLPGTAPKLLIYDNNQRPSGIPDRFSGSKSGTSATLAITGLQTGDEADYYCGTWDNSLSPHLLFGGGTKLTVL

SEQ ID NO: 4398 - protein, 13 aa, Artificial Sequence
  Description of Artificial Sequence: Synthetic peptide
  SH1C8[PD-L1] vlCDR1
SGSSSDIGNHYVS

SEQ ID NO: 4399 - protein, 7 aa, Artificial Sequence
  Description of Artificial Sequence: Synthetic peptide
  SH1C8[PD-L1] vlCDR2
DNNQRPS

SEQ ID NO: 4400 - protein, 12 aa, Artificial Sequence
  Description of Artificial Sequence: Synthetic peptide
  SH1C8[PD-L1] vlCDR3
GTWDNSLSPHLL

SEQ ID NO: 4401 - protein, 123 aa, Artificial Sequence
  Description of Artificial Sequence: Synthetic polypeptide
  H1H9364P2[PD-L1] variable heavy Chain
EVQLVESGGGLVQPGRSLRLSCAASGFTFDDYALHWVRQAPGKGLEWVSGISWTGGTIDYADSVKGRFTISRDNAKNSLYLQMSSLRTEDTAIYYCTRDIRGNWKYGGWFDPWGQGTLVTVSS

SEQ ID NO: 4402 - protein, 5 aa, Artificial Sequence
  Description of Artificial Sequence: Synthetic peptide
  H1H9364P2[PD-L1] vhCDR1
DYALH

SEQ ID NO: 4403 - protein, 17 aa, Artificial Sequence
  Description of Artificial Sequence: Synthetic peptide
  H1H9364P2[PD-L1] vhCDR2
GISWTGGTIDYADSVKG

SEQ ID NO: 4404 - protein, 14 aa, Artificial Sequence
  Description of Artificial Sequence: Synthetic peptide
  H1H9364P2[PD-L1] vhCDR3
DIRGNWKYGGWFDP

SEQ ID NO: 4405 - protein, 108 aa, Artificial Sequence
  Description of Artificial Sequence: Synthetic polypeptide
  H1H9364P2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 4406 - protein, 11 aa, Artificial Sequence
  Description of Artificial Sequence: Synthetic peptide
  H1H9364P2[PD-L1] vlCDR1
RASQSISSYLN

SEQ ID NO: 4407 - protein, 7 aa, Artificial Sequence
  Description of Artificial Sequence: Synthetic peptide
  H1H9364P2[PD-L1] vlCDR2
AASSLQS

SEQ ID NO: 4408 - protein, 10 aa, Artificial Sequence
  Description of Artificial Sequence: Synthetic peptide
  H1H9364P2[PD-L1] vlCDR3
QQSYSTPPIT

SEQ ID NO: 4409 - protein, 120 aa, Artificial Sequence
  Description of Artificial Sequence: Synthetic polypeptide
  H1H9373P2[PD-L1] variable heavy Chain
QVQLVQSGTEVKKPGASVKVSCKASGYTFTAYYMHWVRQAPGQGLDWMGWISPNSGFTNYAQKFQGRVTMTRDTSINTFYMELSGLRSDDTAVYYCAREGSTHHNSFDPWGQGTLVTVSS

SEQ ID NO: 4410 - protein, 5 aa, Artificial Sequence
  Description of Artificial Sequence: Synthetic peptide
  H1H9373P2[PD-L1] vhCDR1
AYYMH

SEQ ID NO: 4411 - protein, 17 aa, Artificial Sequence
  Description of Artificial Sequence: Synthetic peptide
  H1H9373P2[PD-L1] vhCDR2
WISPNSGFTNYAQKFQG

SEQ ID NO: 4412 - protein, 11 aa, Artificial Sequence
  Description of Artificial Sequence: Synthetic peptide
  H1H9373P2[PD-L1] vhCDR3
EGSTHHNSFDP

SEQ ID NO: 4413 - protein, 108 aa, Artificial Sequence; identical to SEQ ID NO: 4405
  Description of Artificial Sequence: Synthetic polypeptide
  H1H9373P2[PD-L1] variable light Chain

SEQ ID NO: 4414 - protein, 11 aa, Artificial Sequence
  Description of Artificial Sequence: Synthetic peptide
  H1H9373P2[PD-L1] vlCDR1
RASQSISSYLN

SEQ ID NO: 4415 - protein, 7 aa, Artificial Sequence
  Description of Artificial Sequence: Synthetic peptide
  H1H9373P2[PD-L1] vlCDR2
AASSLQS

SEQ ID NO: 4416 - protein, 10 aa, Artificial Sequence
  Description of Artificial Sequence: Synthetic peptide
  H1H9373P2[PD-L1] vlCDR3
QQSYSTPPIT

SEQ ID NO: 4417 - protein, 120 aa, Artificial Sequence
  Description of Artificial Sequence: Synthetic polypeptide
  H1H8314N[PD-L1] variable heavy Chain
EVQLVESGGGVVRPGGSLRLSCAASGFTFDDYGMTWVRQAPGRGLEWVSGIHWHGKRTGYADSVKGRFTISRDNAKKSLYLQMNSLKGEDTALYHCVRGGMSTGDWFDPWGQGTLVIVSS

SEQ ID NO: 4418 - protein, 5 aa, Artificial Sequence
  Description of Artificial Sequence: Synthetic peptide
  H1H8314N[PD-L1] vhCDR1
DYGMT

SEQ ID NO: 4419 - protein, 17 aa, Artificial Sequence
  Description of Artificial Sequence: Synthetic peptide
  H1H8314N[PD-L1] vhCDR2
GIHWHGKRTGYADSVKG

SEQ ID NO: 4420 - protein, 11 aa, Artificial Sequence
  Description of Artificial Sequence: Synthetic peptide
  H1H8314N[PD-L1] vhCDR3
GGMSTGDWFDP

SEQ ID NO: 4421 - protein, 108 aa, Artificial Sequence
  Description of Artificial Sequence: Synthetic polypeptide
  H1H8314N[PD-L1] variable light Chain
DIQMTQSPSSLSASLGDRVTITCRASQSINSYLNWYQQKPGKAPKLLIYVASSLQSGVPSRFSGSGSGTEFTLTISNLQPEDFATYYCQQSYSTPPITFGQGTRLEIK

SEQ ID NO: 4422 - protein, 11 aa, Artificial Sequence
  Description of Artificial Sequence: Synthetic peptide
  H1H8314N[PD-L1] vlCDR1
RASQSINSYLN

SEQ ID NO: 4423 - protein, 7 aa, Artificial Sequence
  Description of Artificial Sequence: Synthetic peptide
  H1H8314N[PD-L1] vlCDR2
VASSLQS

SEQ ID NO: 4424 - protein, 10 aa, Artificial Sequence
  Description of Artificial Sequence: Synthetic peptide
  H1H8314N[PD-L1] vlCDR3
QQSYSTPPIT

SEQ ID NO: 4425 - protein, 119 aa, Artificial Sequence
  Description of Artificial Sequence: Synthetic polypeptide
  PDL1.3.1[PD-L1] variable heavy Chain
EVQLQQSGTELVKPGASVKLSCTTSGFNIQDTYMHWVKQRPEQGLEWIGWIDPANGNTKYDPKFQGKATIIADTSSNTAYLQLRGLTSEDTAVYYCARSGVSTAHFDYWGQGTTLTVSS

SEQ ID NO: 4426 - protein, 5 aa, Artificial Sequence
  Description of Artificial Sequence: Synthetic peptide
  PDL1.3.1[PD-L1] vhCDR1
DTYMH

SEQ ID NO: 4427 - protein, 17 aa, Artificial Sequence
  Description of Artificial Sequence: Synthetic peptide
  PDL1.3.1[PD-L1] vhCDR2
WIDPANGNTKYDPKFQG

SEQ ID NO: 4428 - protein, 10 aa, Artificial Sequence
  Description of Artificial Sequence: Synthetic peptide
  PDL1.3.1[PD-L1] vhCDR3
SGVSTAHFDY

SEQ ID NO: 4429 - protein, 106 aa, Artificial Sequence
  Description of Artificial Sequence: Synthetic polypeptide
  PDL1.3.1[PD-L1] variable light Chain
QIVLSQSPAILSASPGEKVTMTCRASSSVSFMHWYQQKPGSSPKPWIYATSNLASGVPTRFSGSGSGTSYSLTLSRVEAEDAATYYCQQWSSYPRTFGGGTKLEIK

SEQ ID NO: 4430 - protein, 10 aa, Artificial Sequence
  Description of Artificial Sequence: Synthetic peptide
  PDL1.3.1[PD-L1] vlCDR1
RASSSVSFMH

SEQ ID NO: 4431 - protein, 7 aa, Artificial Sequence
  Description of Artificial Sequence: Synthetic peptide
  PDL1.3.1[PD-L1] vlCDR2
ATSNLAS

SEQ ID NO: 4432 - protein, 9 aa, Artificial Sequence
  Description of Artificial Sequence: Synthetic peptide
  PDL1.3.1[PD-L1] vlCDR3
QQWSSYPRT

SEQ ID NO: 4433 - protein, 119 aa, Artificial Sequence
  Description of Artificial Sequence: Synthetic polypeptide
  10A7[TIGIT] variable heavy Chain
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSS

SEQ ID NO: 4434 - protein, 5 aa, Artificial Sequence
  Description of Artificial Sequence: Synthetic peptide
  10A7[TIGIT] vhCDR1
SFTMH

SEQ ID NO: 4435 - protein, 17 aa, Artificial Sequence
  Description of Artificial Sequence: Synthetic peptide
  10A7[TIGIT] vhCDR2
FIRSGSGIVFYADAVRG

SEQ ID NO: 4436 - protein, 10 aa, Artificial Sequence
  Description of Artificial Sequence: Synthetic peptide
  10A7[TIGIT] vhCDR3
RPLGHNTFDS

SEQ ID NO: 4437 - protein, 113 aa, Artificial Sequence
  Description of Artificial Sequence: Synthetic polypeptide
  10A7[TIGIT] variable light Chain
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIK

SEQ ID NO: 4438 - protein, 17 aa, Artificial Sequence
  Description of Artificial Sequence: Synthetic peptide
  10A7[TIGIT] vlCDR1
KSSQSLYYSGVKENLLA

SEQ ID NO: 4439 - protein, 7 aa, Artificial Sequence
  Description of Artificial Sequence: Synthetic peptide
  10A7[TIGIT] vlCDR2
YASIRFT

SEQ ID NO: 4440 - protein, 9 aa, Artificial Sequence
  Description of Artificial Sequence: Synthetic peptide
  10A7[TIGIT] vlCDR3
QQGINNPLT

SEQ ID NO: 4441 - protein, 119 aa, Artificial Sequence
  Description of Artificial Sequence: Synthetic polypeptide
  1F4[TIGIT] variable heavy Chain
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSS

SEQ ID NO: 4442 - protein, 5 aa, Artificial Sequence
  Description of Artificial Sequence: Synthetic peptide
  1F4[TIGIT] vhCDR1
GHLMN

SEQ ID NO: 4443 - protein, 17 aa, Artificial Sequence
  Description of Artificial Sequence: Synthetic peptide
  1F4[TIGIT] vhCDR2
LIIPYNGGTSYNQKFKG

SEQ ID NO: 4444 - protein, 10 aa, Artificial Sequence
  Description of Artificial Sequence: Synthetic peptide
  1F4[TIGIT] vhCDR3
GLRGFYAMDY

SEQ ID NO: 4445 - protein, 112 aa, Artificial Sequence
  Description of Artificial Sequence: Synthetic polypeptide
  1F4[TIGIT] variable light Chain
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVK

SEQ ID NO: 4446 - protein, 16 aa, Artificial Sequence
  Description of Artificial Sequence: Synthetic peptide
  1F4[TIGIT] vlCDR1
RSSQSLVNSYGNTFLS

SEQ ID NO: 4447 - protein, 7 aa, Artificial Sequence
  Description of Artificial Sequence: Synthetic peptide
  1F4[TIGIT] vlCDR2
GISNRFS

SEQ ID NO: 4448 - protein, 9 aa, Artificial Sequence
  Description of Artificial Sequence: Synthetic peptide
  1F4[TIGIT] vlCDR3
LQGTHQPPT

SEQ ID NO: 4449 - protein, 126 aa, Artificial Sequence
  Description of Artificial Sequence: Synthetic polypeptide
  4.1D3[TIGIT] variable heavy Chain
QVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 4450 - protein, 7 aa, Artificial Sequence
  Description of Artificial Sequence: Synthetic peptide
  4.1D3[TIGIT] vhCDR1
SNSAAWN

SEQ ID NO: 4451 - protein, 18 aa, Artificial Sequence
  Description of Artificial Sequence: Synthetic peptide
  4.1D3[TIGIT] vhCDR2
KTYYRFKWYSDYAVSVKG

SEQ ID NO: 4452 - protein, 14 aa, Artificial Sequence
  Description of Artificial Sequence: Synthetic peptide
  4.1D3[TIGIT] vhCDR3
ESTTYDLLAGPFDY

SEQ ID NO: 4453 - protein, 113 aa, Artificial Sequence
  Description of Artificial Sequence: Synthetic polypeptide
  4.1D3[TIGIT] variable light Chain
DIVMTQSPDSLAVSLGERATINCKSSQTVLYSSNNKKYLAWYQQKPGQPPNLLIYWASTRESGVPDRFSGSGSGTDFTLTISSLQAEDVAVYYCQQYYSTPFTFGPGTKVEIK

SEQ ID NO: 4454 - protein, 17 aa, Artificial Sequence
  Description of Artificial Sequence: Synthetic peptide
  4.1D3[TIGIT] vlCDR1
KSSQTVLYSSNNKKYLA

SEQ ID NO: 4455 - protein, 7 aa, Artificial Sequence
  Description of Artificial Sequence: Synthetic peptide
  4.1D3[TIGIT] vlCDR2
WASTRES

SEQ ID NO: 4456 - protein, 9 aa, Artificial Sequence
  Description of Artificial Sequence: Synthetic peptide
  4.1D3[TIGIT] vlCDR3
QQYYSTPFT

SEQ ID NO: 4457 - protein, 126 aa, Artificial Sequence
  Description of Artificial Sequence: Synthetic polypeptide
  4.1D3.Q1E[TIGIT] variable heavy Chain
EVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 4458 - protein, 7 aa, Artificial Sequence
  Description of Artificial Sequence: Synthetic peptide
  4.1D3.Q1E[TIGIT] vhCDR1
SNSAAWN

SEQ ID NO: 4459 - protein, 18 aa, Artificial Sequence
  Description of Artificial Sequence: Synthetic peptide
  4.1D3.Q1E[TIGIT] vhCDR2
KTYYRFKWYSDYAVSVKG

SEQ ID NO: 4460 - protein, 14 aa, Artificial Sequence
  Description of Artificial Sequence: Synthetic peptide
  4.1D3.Q1E[TIGIT] vhCDR3
ESTTYDLLAGPFDY

SEQ ID NO: 4461 - protein, 113 aa, Artificial Sequence; identical to SEQ ID NO: 4453
  Description of Artificial Sequence: Synthetic polypeptide
  4.1D3.Q1E[TIGIT] variable light Chain

SEQ ID NO: 4462 - protein, 17 aa, Artificial Sequence
  Description of Artificial Sequence: Synthetic peptide
  4.1D3.Q1E[TIGIT] vlCDR1
KSSQTVLYSSNNKKYLA

SEQ ID NO: 4463 - protein, 7 aa, Artificial Sequence
  Description of Artificial Sequence: Synthetic peptide
  4.1D3.Q1E[TIGIT] vlCDR2
WASTRES

SEQ ID NO: 4464 - protein, 9 aa, Artificial Sequence
  Description of Artificial Sequence: Synthetic peptide
  4.1D3.Q1E[TIGIT] vlCDR3
QQYYSTPFT

SEQ ID NO: 4465 - protein, 121 aa, Artificial Sequence
  Description of Artificial Sequence: Synthetic polypeptide
  Hu14D7 VH1[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSTVYLQMNSLRAEDTAVYYCRGALYDGFYFDYWGQGTLVTVSS

SEQ ID NO: 4466 - protein, 5 aa, Artificial Sequence
  Description of Artificial Sequence: Synthetic peptide
  Hu14D7 VH1[TIGIT] vhCDR1
GAWMD

SEQ ID NO: 4467 - protein, 19 aa, Artificial Sequence
  Description of Artificial Sequence: Synthetic peptide
  Hu14D7 VH1[TIGIT] vhCDR2
EIRTKVNNHATNYGESVKG

SEQ ID NO: 4468 - protein, 10 aa, Artificial Sequence
  Description of Artificial Sequence: Synthetic peptide
  Hu14D7 VH1[TIGIT] vhCDR3
ALYDGFYFDY

SEQ ID NO: 4469 - protein, 121 aa, Artificial Sequence
  Description of Artificial Sequence: Synthetic polypeptide
  Hu14D7 VH2[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSSVYLQMNSLRAEDTAVYYCRGALYDGFYFDYWGQGTLVTVSS

SEQ ID NO: 4470 - protein, 5 aa, Artificial Sequence
  Description of Artificial Sequence: Synthetic peptide
  Hu14D7 VH2[TIGIT] vhCDR1
GAWMD

SEQ ID NO: 4471 - protein, 19 aa, Artificial Sequence
  Description of Artificial Sequence: Synthetic peptide
  Hu14D7 VH2[TIGIT] vhCDR2
EIRTKVNNHATNYGESVKG

SEQ ID NO: 4472 - protein, 10 aa, Artificial Sequence
  Description of Artificial Sequence: Synthetic peptide
  Hu14D7 VH2[TIGIT] vhCDR3
ALYDGFYFDY

SEQ ID NO: 4473 - protein, 121 aa, Artificial Sequence
  Description of Artificial Sequence: Synthetic polypeptide
  Hu14D7 VH3[TIGIT] variable heavy Chain
EVQLVESGGGLVQPGGSLKLSCAASGFTFSGAWMDWVRQAPGKGLEWVAEIRTKVNNHATNYGESVKGRFTISRDDSKNTVYLQMNSLRAEDTAVYYCRGALYDGFYFDYWGQGTLVTVSS

SEQ ID NO: 4474 - protein, 5 aa, Artificial Sequence
  Description of Artificial Sequence: Synthetic peptide
  Hu14D7 VH3[TIGIT] vhCDR1
GAWMD

SEQ ID NO: 4475 - protein, 19 aa, Artificial Sequence
  Description of Artificial Sequence: Synthetic peptide
  Hu14D7 VH3[TIGIT] vhCDR2
EIRTKVNNHATNYGESVKG

SEQ ID NO: 4476 - protein, 10 aa, Artificial Sequence
  Description of Artificial Sequence: Synthetic peptide
  Hu14D7 VH3[TIGIT] vhCDR3
ALYDGFYFDY

SEQ ID NO: 4477 - protein, 108 aa, Artificial Sequence
  Description of Artificial Sequence: Synthetic polypeptide
  Hu14D7 VL1[TIGIT] variable light Chain
EIVLTQSPATLSLSPGERATLSCSASSSVSSGYLYWYQQKPGQAPKLWIYGTSTLASGVPARFSGSGSGTDYTLTISSLEPEDFAVYYCHQWSSFPYTFGQGTKLEIK

SEQ ID NO: 4478 - protein, 12 aa, Artificial Sequence
  Description of Artificial Sequence: Synthetic peptide
  Hu14D7 VL1[TIGIT] vlCDR1
SASSSVSSGYLY

SEQ ID NO: 4479 - protein, 7 aa, Artificial Sequence
  Description of Artificial Sequence: Synthetic peptide
  Hu14D7 VL1[TIGIT] vlCDR2
GTSTLAS

SEQ ID NO: 4480 - protein, 9 aa, Artificial Sequence
  Description of Artificial Sequence: Synthetic peptide
  Hu14D7 VL1[TIGIT] vlCDR3
HQWSSFPYT

SEQ ID NO: 4481 - protein, 108 aa, Artificial Sequence
  Description of Artificial Sequence: Synthetic polypeptide
  Hu14D7 VL2[TIGIT] variable light Chain
EIVLTQSPATLSLSPGERATLSCSASSSVSSGYLYWYQQKPGQAPRLWIYGTSTLASGVPARFSGSGSGTDYTLTISSLEPEDFAVYYCHQWSSFPYTFGQGTKLEIK

SEQ ID NO: 4482 - protein, 12 aa, Artificial Sequence
  Description of Artificial Sequence: Synthetic peptide
  Hu14D7 VL2[TIGIT] vlCDR1
SASSSVSSGYLY

SEQ ID NO: 4483 - protein, 7 aa, Artificial Sequence
  Description of Artificial Sequence: Synthetic peptide
  Hu14D7 VL2[TIGIT] vlCDR2
GTSTLAS

SEQ ID NO: 4484 - protein, 9 aa, Artificial Sequence
  Description of Artificial Sequence: Synthetic peptide
  Hu14D7 VL2[TIGIT] vlCDR3
HQWSSFPYT

SEQ ID NO: 4485 - protein, 108 aa, Artificial Sequence
  Description of Artificial Sequence: Synthetic polypeptide
  Hu14D7 VL3[TIGIT] variable light Chain
EIVLTQSPATLSLSPGERATLSCSASSSVSSGYLYWYQQKPGQAPRLWIYGTSTLASGIPARFSGSGSGTDYTLTISSLEPEDFAVYYCHQWSSFPYTFGQGTKLEIK

SEQ ID NO: 4486 - protein, 12 aa, Artificial Sequence
  Description of Artificial Sequence: Synthetic peptide
  Hu14D7 VL3[TIGIT] vlCDR1
SASSSVSSGYLY

SEQ ID NO: 4487 - protein, 7 aa, Artificial Sequence
  Description of Artificial Sequence: Synthetic peptide
  Hu14D7 VL3[TIGIT] vlCDR2
GTSTLAS

SEQ ID NO: 4488 - protein, 9 aa, Artificial Sequence
  Description of Artificial Sequence: Synthetic peptide
  Hu14D7 VL3[TIGIT] vlCDR3
HQWSSFPYT

SEQ ID NO: 4489 - protein, 119 aa, Artificial Sequence
  Description of Artificial Sequence: Synthetic polypeptide
  Hu26B10 VH1[TIGIT] variable heavy Chain
EVQLVQSGAEVKKPGASVKISCKTSGYTFTEFTMHWVKQAPGKGLEWIGGLKPDNGGISYNQKFKGRATLTVDKSTNTAYMELSSLRSEDTAVYYCARGAYYRYDADYWGQGTLVTVSS

SEQ ID NO: 4490 - protein, 5 aa, Artificial Sequence
  Description of Artificial Sequence: Synthetic peptide
  Hu26B10 VH1[TIGIT] vhCDR1
EFTMH

SEQ ID NO: 4491 - protein, 17 aa, Artificial Sequence
  Description of Artificial Sequence: Synthetic peptide
  Hu26B10 VH1[TIGIT] vhCDR2
GLKPDNGGISYNQKFKG

SEQ ID NO: 4492 - protein, 10 aa, Artificial Sequence
  Description of Artificial Sequence: Synthetic peptide
  Hu26B10 VH1[TIGIT] vhCDR3
GAYYRYDADY

SEQ ID NO: 4493 - protein, 119 aa, Artificial Sequence
  Description of Artificial Sequence: Synthetic polypeptide
  Hu26B10 VH2[TIGIT] variable heavy Chain
EVQLVQSGAEVKKPGASVKISCKTSGYTFTEFTMHWVRQAPGKGLEWIGGLKPDNGGISYNQKFKGRATLTVDKSTSTAYMELSSLRSEDTAVYYCARGAYYRYDADYWGQGTLVTVSS

SEQ ID NO: 4494 - protein, 5 aa, Artificial Sequence
  Description of Artificial Sequence: Synthetic peptide
  Hu26B10 VH2[TIGIT] vhCDR1
EFTMH

SEQ ID NO: 4495 - protein, 17 aa, Artificial Sequence
  Description of Artificial Sequence: Synthetic peptide
  Hu26B10 VH2[TIGIT] vhCDR2
GLKPDNGGISYNQKFKG

SEQ ID NO: 4496 - protein, 10 aa, Artificial Sequence
  Description of Artificial Sequence: Synthetic peptide
  Hu26B10 VH2[TIGIT] vhCDR3
GAYYRYDADY

SEQ ID NO: 4497 - protein, 119 aa, Artificial Sequence
  Description of Artificial Sequence: Synthetic polypeptide
  Hu26B10 VH3[TIGIT] variable heavy Chain
EVQLVQSGAEVKKPGASVKISCKVSGYTFTEFTMHWVRQAPGKGLEWIGGLKPDNGGISYNQKFKGRATLTVDTSTSTAYMELSSLRSEDTAVYYCARGAYYRYDADYWGQGTLVTVSS

SEQ ID NO: 4498 - protein, 5 aa, Artificial Sequence
  Description of Artificial Sequence: Synthetic peptide
  Hu26B10 VH3[TIGIT] vhCDR1
EFTMH

SEQ ID NO: 4499 - protein, 17 aa, Artificial Sequence
  Description of Artificial Sequence: Synthetic peptide
  Hu26B10 VH3[TIGIT] vhCDR2
GLKPDNGGISYNQKFKG

SEQ ID NO: 4500 - protein, 10 aa, Artificial Sequence
  Description of Artificial Sequence: Synthetic peptide
  Hu26B10 VH3[TIGIT] vhCDR3
GAYYRYDADY

SEQ ID NO: 4501 - protein, 107 aa, Artificial Sequence
  Description of Artificial Sequence: Synthetic polypeptide
  Hu26B10 VL1[TIGIT] variable light Chain
DIQLTQSPSSLSASVGDRVTITCKASQDVKTAVAWYQQKPGKAPKLLIYSASYRNTGVPDRFSGSGSGTDFTFTISSLQPEDFATYYCQQHYSTPFTFGQGTKLEIK

SEQ ID NO: 4502 - protein, 11 aa, Artificial Sequence
  Description of Artificial Sequence: Synthetic peptide
  Hu26B10 VL1[TIGIT] vlCDR1
KASQDVKTAVA

SEQ ID NO: 4503 - protein, 7 aa, Artificial Sequence
  Description of Artificial Sequence: Synthetic peptide
  Hu26B10 VL1[TIGIT] vlCDR2
SASYRNT

SEQ ID NO: 4504 - protein, 9 aa, Artificial Sequence
  Description of Artificial Sequence: Synthetic peptide
  Hu26B10 VL1[TIGIT] vlCDR3
QQHYSTPFT

SEQ ID NO: 4505 - protein, 107 aa, Artificial Sequence
  Description of Artificial Sequence: Synthetic polypeptide
  Hu26B10 VL2[TIGIT] variable light Chain
DIQLTQSPSSLSASVGDRVTITCKASQDVKTAVAWYQQKPGKAPKLLIYSASYRNTGVPSRFSGSGSGTDFTFTISSLQPEDFATYYCQQHYSTPFTFGQGTKLEIK

SEQ ID NO: 4506 - protein, 11 aa, Artificial Sequence
  Description of Artificial Sequence: Synthetic peptide
  Hu26B10 VL2[TIGIT] vlCDR1
KASQDVKTAVA

SEQ ID NO: 4507 - protein, 7 aa, Artificial Sequence
  Description of Artificial Sequence: Synthetic peptide
  Hu26B10 VL2[TIGIT] vlCDR2
SASYRNT

SEQ ID NO: 4508 - protein, 9 aa, Artificial Sequence
  Description of Artificial Sequence: Synthetic peptide
  Hu26B10 VL2[TIGIT] vlCDR3
QQHYSTPFT

SEQ ID NO: 4509 - protein, 107 aa, Artificial Sequence
  Description of Artificial Sequence: Synthetic polypeptide
  Hu26B10 VL3[TIGIT] variable light Chain
DIQLTQSPSSLSASVGDRVTITCKASQDVKTAVAWYQQKPGKAPKLLIYSASYRNTGVPSRFSGSGSGTDFTLTISSLQPEDFATYYCQQHYSTPFTFGQGTKLEIK

SEQ ID NO: 4510 - protein, 11 aa, Artificial Sequence
  Description of Artificial Sequence: Synthetic peptide
  Hu26B10 VL3[TIGIT] vlCDR1
KASQDVKTAVA

SEQ ID NO: 4511 - protein, 7 aa, Artificial Sequence
  Description of Artificial Sequence: Synthetic peptide
  Hu26B10 VL3[TIGIT] vlCDR2
SASYRNT

SEQ ID NO: 4512 - protein, 9 aa, Artificial Sequence
  Description of Artificial Sequence: Synthetic peptide
  Hu26B10 VL3[TIGIT] vlCDR3
QQHYSTPFT

SEQ ID NO: 4513 - protein, 119 aa, Artificial Sequence
  Description of Artificial Sequence: Synthetic polypeptide
  MEB125.31C6.A1.205 VH4/VL1[TIGIT] variable heavy Chain
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 4514 - protein, 5 aa, Artificial Sequence
  Description of Artificial Sequence: Synthetic peptide
  MEB125.31C6.A1.205 VH4/VL1[TIGIT] vhCDR1
SYVMH

SEQ ID NO: 4515 - protein, 17 aa, Artificial Sequence
  Description of Artificial Sequence: Synthetic peptide
  MEB125.31C6.A1.205 VH4/VL1[TIGIT] vhCDR2
YIDPYNDGAKYAQKFQG

SEQ ID NO: 4516 - protein, 10 aa, Artificial Sequence
  Description of Artificial Sequence: Synthetic peptide
  MEB125.31C6.A1.205 VH4/VL1[TIGIT] vhCDR3
GGPYGWYFDV

SEQ ID NO: 4517 - protein, 107 aa, Artificial Sequence
  Description of Artificial Sequence: Synthetic polypeptide
  MEB125.31C6.A1.205 VH4/VL1[TIGIT] variable heavy Chain
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 4518 - protein, 11 aa, Artificial Sequence
  Description of Artificial Sequence: Synthetic peptide
  MEB125.31C6.A1.205 VH4/VL1[TIGIT] vhCDR1
RASEHIYSYLS

SEQ ID NO: 4519 - protein, 7 aa, Artificial Sequence
  Description of Artificial Sequence: Synthetic peptide
  MEB125.31C6.A1.205 VH4/VL1[TIGIT] vhCDR2
NAKTLAE

SEQ ID NO: 4520 - protein, 9 aa, Artificial Sequence
  Description of Artificial Sequence: Synthetic peptide
  MEB125.31C6.A1.205 VH4/VL1[TIGIT] vhCDR3
QHHFGSPLT

SEQ ID NO: 4521 - protein, 119 aa, Artificial Sequence
  Description of Artificial Sequence: Synthetic polypeptide
  MEB125.31C6.A1.205 VH5/VL4[TIGIT] variable heavy Chain
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 4522 - protein, 5 aa, Artificial Sequence
  Description of Artificial Sequence: Synthetic peptide
  MEB125.31C6.A1.205 VH5/VL4[TIGIT] vhCDR1
SYVMH

SEQ ID NO: 4523 - protein, 17 aa, Artificial Sequence
  Description of Artificial Sequence: Synthetic peptide
  MEB125.31C6.A1.205 VH5/VL4[TIGIT] vhCDR2
YIDPYNDGAKYAQKFQG

SEQ ID NO: 4524 - protein, 10 aa, Artificial Sequence
  Description of Artificial Sequence: Synthetic peptide
  MEB125.31C6.A1.205 VH5/VL4[TIGIT] vhCDR3
GGPYGWYFDV

SEQ ID NO: 4525 - protein, 107 aa, Artificial Sequence
  Description of Artificial Sequence: Synthetic polypeptide
  MEB125.31C6.A1.205 VH5/VL4[TIGIT] variable heavy Chain
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 4526 - protein, 11 aa, Artificial Sequence
  Description of Artificial Sequence: Synthetic peptide
  MEB125.31C6.A1.205 VH5/VL4[TIGIT] vhCDR1
RASEHIYSYLS

SEQ ID NO: 4527 - protein, 7 aa, Artificial Sequence
  Description of Artificial Sequence: Synthetic peptide
  MEB125.31C6.A1.205 VH5/VL4[TIGIT] vhCDR2
NAKTLAE

SEQ ID NO: 4528 - protein, 9 aa, Artificial Sequence
  Description of Artificial Sequence: Synthetic peptide
  MEB125.31C6.A1.205 VH5/VL4[TIGIT] vhCDR3
QHHFGSPLT

SEQ ID NO: 4529 - protein, 119 aa, Artificial Sequence; identical to SEQ ID NO: 4521
  Description of Artificial Sequence: Synthetic polypeptide
  MEB125.31C6.A1.205 VH5/VL3[TIGIT] variable heavy Chain

SEQ ID NO: 4530 - protein, 5 aa, Artificial Sequence
  Description of Artificial Sequence: Synthetic peptide
  MEB125.31C6.A1.205 VH5/VL3[TIGIT] vhCDR1
SYVMH

SEQ ID NO: 4531 - protein, 17 aa, Artificial Sequence
  Description of Artificial Sequence: Synthetic peptide
  MEB125.31C6.A1.205 VH5/VL3[TIGIT] vhCDR2
YIDPYNDGAKYAQKFQG

SEQ ID NO: 4532 - protein, 10 aa, Artificial Sequence
  Description of Artificial Sequence: Synthetic peptide
  MEB125.31C6.A1.205 VH5/VL3[TIGIT] vhCDR3
GGPYGWYFDV

SEQ ID NO: 4533 - protein, 107 aa, Artificial Sequence
  Description of Artificial Sequence: Synthetic polypeptide
  MEB125.31C6.A1.205 VH5/VL3[TIGIT] variable heavy Chain
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 4534 - protein, 11 aa, Artificial Sequence
  Description of Artificial Sequence: Synthetic peptide
  MEB125.31C6.A1.205 VH5/VL3[TIGIT] vhCDR1
RASEHIYSYLS

SEQ ID NO: 4535 - protein, 7 aa, Artificial Sequence
  Description of Artificial Sequence: Synthetic peptide
  MEB125.31C6.A1.205 VH5/VL3[TIGIT] vhCDR2
NAKTLAE

SEQ ID NO: 4536 - protein, 9 aa, Artificial Sequence
  Description of Artificial Sequence: Synthetic peptide
  MEB125.31C6.A1.205 VH5/VL3[TIGIT] vhCDR3
QHHFGSPLT

SEQ ID NO: 4537 - protein, 118 aa, Artificial Sequence
  Description of Artificial Sequence: Synthetic polypeptide
  15A6[TIGIT] variable heavy Chain
QLQLQESGPGLVKPSETLSLTCTVSGGSISSSRYFWGWIRQPPGKGLEWIGYIYYRGSTYYNPSLKSRVTIAVDTSKNQFSLKLSSVTAADTAVYYCASSSAWYFDYWGQGNLVTVSS

SEQ ID NO: 4538 - protein, 7 aa, Artificial Sequence
  Description of Artificial Sequence: Synthetic peptide
  15A6[TIGIT] vhCDR1
SSRYFWG

SEQ ID NO: 4539 - protein, 16 aa, Artificial Sequence
  Description of Artificial Sequence: Synthetic peptide
  15A6[TIGIT] vhCDR2
YIYYRGSTYYNPSLKS

SEQ ID NO: 4540 - protein, 8 aa, Artificial Sequence
  Description of Artificial Sequence: Synthetic peptide
  15A6[TIGIT] vhCDR3
SSAWYFDY

SEQ ID NO: 4541 - protein, 107 aa, Artificial Sequence
  Description of Artificial Sequence: Synthetic polypeptide
  15A6[TIGIT] variable light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSLYTFGQGTKLEIK

SEQ ID NO: 4542 - protein, 12 aa, Artificial Sequence
  Description of Artificial Sequence: Synthetic peptide
  15A6[TIGIT] vlCDR1
RASQSVSSSYLA

SEQ ID NO: 4543 - protein, 7 aa, Artificial Sequence
  Description of Artificial Sequence: Synthetic peptide
  15A6[TIGIT] vlCDR2
GASSRAT

SEQ ID NO: 4544 - protein, 8 aa, Artificial Sequence
  Description of Artificial Sequence: Synthetic peptide
  15A6[TIGIT] vlCDR3
QQYGSLYT

SEQ ID NO: 4545 - protein, 130 aa, Artificial Sequence
  Description of Artificial Sequence: Synthetic polypeptide
  22G2[TIGIT] variable heavy Chain
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 4546 - protein, 7 aa, Artificial Sequence
  Description of Artificial Sequence: Synthetic peptide
  22G2[TIGIT] vhCDR1
SGIYYWS

SEQ ID NO: 4547 - protein, 16 aa, Artificial Sequence
  Description of Artificial Sequence: Synthetic peptide
  22G2[TIGIT] vhCDR2
YIYYSGSTNYNPSLKS

SEQ ID NO: 4548 - protein, 20 aa, Artificial Sequence
  Description of Artificial Sequence: Synthetic peptide
  22G2[TIGIT] vhCDR3
DYYVSGNYYNVDYYFFGVDV

SEQ ID NO: 4549 - protein, 109 aa, Artificial Sequence
  Description of Artificial Sequence: Synthetic polypeptide
  22G2[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 4550 - protein, 11 aa, Artificial Sequence
  Description of Artificial Sequence: Synthetic peptide
  22G2[TIGIT] vlCDR1
RASQSVSSYLA

SEQ ID NO: 4551 - protein, 7 aa, Artificial Sequence
  Description of Artificial Sequence: Synthetic peptide
  22G2[TIGIT] vlCDR2
DASNRAT

SEQ ID NO: 4552 - protein, 11 aa, Artificial Sequence
  Description of Artificial Sequence: Synthetic peptide
  22G2[TIGIT] vlCDR3
QQRSNWPPLFT

SEQ ID NO: 4553 - protein, 126 aa, Artificial Sequence
  Description of Artificial Sequence: Synthetic polypeptide
  11G11[TIGIT] variable heavy Chain
QLQLQESGPGLVKPSETLSLTCTVSGGSISSSSHYWGWIRQPPGKGLEWIGNIFYSGHTYYNPSLKSRVTISVDTSKNQFSLKLSSVTAADTAVYYCARQGLLWFGGLSPYYFDYWGQGTLVTVSS

SEQ ID NO: 4554 - protein, 7 aa, Artificial Sequence
  Description of Artificial Sequence: Synthetic peptide
  11G11[TIGIT] vhCDR1
SSSHYWG

SEQ ID NO: 4555 - protein, 16 aa, Artificial Sequence
  Description of Artificial Sequence: Synthetic peptide
  11G11[TIGIT] vhCDR2
NIFYSGHTYYNPSLKS

SEQ ID NO: 4556 - protein, 16 aa, Artificial Sequence
  Description of Artificial Sequence: Synthetic peptide
  11G11[TIGIT] vhCDR3
QGLLWFGGLSPYYFDY

SEQ ID NO: 4557 - protein, 106 aa, Artificial Sequence
  Description of Artificial Sequence: Synthetic polypeptide
  11G11[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKLEIK

SEQ ID NO: 4558 - protein, 11 aa, Artificial Sequence
  Description of Artificial Sequence: Synthetic peptide
  11G11[TIGIT] vlCDR1
RASQSVSSYLA

SEQ ID NO: 4559 - protein, 7 aa, Artificial Sequence
  Description of Artificial Sequence: Synthetic peptide
  11G11[TIGIT] vlCDR2
DASNRAT

SEQ ID NO: 4560 - protein, 8 aa, Artificial Sequence
  Description of Artificial Sequence: Synthetic peptide
  11G11[TIGIT] vlCDR3
QQRSNWPT

SEQ ID NO: 4561 - protein, 128 aa, Artificial Sequence
  Description of Artificial Sequence: Synthetic polypeptide
  10D7[TIGIT] variable heavy Chain
QGQLVQSGAEVKKPGSSVKVSCKASGGIFRNYAISWVRQAPGQGLEWMGGIIPFFGTANYAQKFQGRVTITADESTSTAYMELSSLRSEDTAVYYCARGGAAAGTTRYGYYYYGMDVWGQGTTVTVSS

SEQ ID NO: 4562 - protein, 5 aa, Artificial Sequence
  Description of Artificial Sequence: Synthetic peptide
  10D7[TIGIT] vhCDR1
NYAIS

SEQ ID NO: 4563 - protein, 17 aa, Artificial Sequence
  Description of Artificial Sequence: Synthetic peptide
  10D7[TIGIT] vhCDR2
GIIPFFGTANYAQKFQG

SEQ ID NO: 4564 - protein, 19 aa, Artificial Sequence
  Description of Artificial Sequence: Synthetic peptide
  10D7[TIGIT] vhCDR3
GGAAAGTTRYGYYYYGMDV

SEQ ID NO: 4565 - protein, 107 aa, Artificial Sequence
  Description of Artificial Sequence: Synthetic polypeptide
  10D7[TIGIT] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 4566 - protein, 11 aa, Artificial Sequence
  Description of Artificial Sequence: Synthetic peptide
  10D7[TIGIT] vlCDR1
RASQGISSWLA

SEQ ID NO: 4567 - protein, 7 aa, Artificial Sequence
  Description of Artificial Sequence: Synthetic peptide
  10D7[TIGIT] vlCDR2
AASSLQS

SEQ ID NO: 4568 - protein, 9 aa, Artificial Sequence
  Description of Artificial Sequence: Synthetic peptide
  10D7[TIGIT] vlCDR3
QQYNSYPIT

SEQ ID NO: 4569 - protein, 116 aa, Artificial Sequence
  Description of Artificial Sequence: Synthetic polypeptide
  313R19[TIGIT] variable heavy Chain
QVQLQESGPGLVKPSETLSLTCTVSGFSLSSSYMSWIRQPPGKGLEWIGIIGSNGNTYYANWAKGRVTISKSSNQVSLKLSSVTAADTAVYYCARGGYRTSGMDPWGQGTLVTVSS

SEQ ID NO: 4570 - protein, 5 aa, Artificial Sequence
  Description of Artificial Sequence: Synthetic peptide
  313R19[TIGIT] vhCDR1
SSYMS

SEQ ID NO: 4571 - protein, 14 aa, Artificial Sequence
  Description of Artificial Sequence: Synthetic peptide
  313R19[TIGIT] vhCDR2
IIGSNGNTYYANWA

SEQ ID NO: 4572 - protein, 10 aa, Artificial Sequence
  Description of Artificial Sequence: Synthetic peptide
  313R19[TIGIT] vhCDR3
GGYRTSGMDP

SEQ ID NO: 4573 - protein, 110 aa, Artificial Sequence
  Description of Artificial Sequence: Synthetic polypeptide
  313R19[TIGIT] variable light Chain
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIK

SEQ ID NO: 4574 - protein, 11 aa, Artificial Sequence
  Description of Artificial Sequence: Synthetic peptide
  313R19[TIGIT] vlCDR1
QASQNIYSDLA

SEQ ID NO: 4575 - protein, 7 aa, Artificial Sequence
  Description of Artificial Sequence: Synthetic peptide
  313R19[TIGIT] vlCDR2
RASTLAS

SEQ ID NO: 4576 - protein, 12 aa, Artificial Sequence
  Description of Artificial Sequence: Synthetic peptide
  313R19[TIGIT] vlCDR3
QQEHLVAWIYNV

SEQ ID NO: 4577 - protein, 118 aa, Artificial Sequence
  Description of Artificial Sequence: Synthetic polypeptide
  313M32[TIGIT] variable heavy Chain
QVQLQESGPGLVKPSETLSLTCAVSGYSITSDYAWNWIRQPPGKGLEWIGYISYSGSTSYNPSLRSRVTISRDTSKNQFFLKLSSVTAADTAVYYCARRQVGLGFAYWGQGTLVTVSS

SEQ ID NO: 4578 - protein, 6 aa, Artificial Sequence
  Description of Artificial Sequence: Synthetic peptide
  313M32[TIGIT] vhCDR1
SDYAWN

SEQ ID NO: 4579 - protein, 16 aa, Artificial Sequence
  Description of Artificial Sequence: Synthetic peptide
  313M32[TIGIT] vhCDR2
YISYSGSTSYNPSLRS

SEQ ID NO: 4580 - protein, 9 aa, Artificial Sequence
  Description of Artificial Sequence: Synthetic peptide
  313M32[TIGIT] vhCDR3
RQVGLGFAY

SEQ ID NO: 4581 - protein, 99 aa, Artificial Sequence
  Description of Artificial Sequence: Synthetic polypeptide
  313M32[TIGIT] variable light Chain
DIQMTQSPSSLSASVGDRVTITCKASQDVSTAVAWYQQKPGKAPKLLIYSASYRYTGVPSRFSGSGSGTDFTFTISSLQPEDIATYYCQQHYSTPWTFG

SEQ ID NO: 4582 - protein, 11 aa, Artificial Sequence
  Description of Artificial Sequence: Synthetic peptide
  313M32[TIGIT] vlCDR1
KASQDVSTAVA

SEQ ID NO: 4583 - protein, 7 aa, Artificial Sequence
  Description of Artificial Sequence: Synthetic peptide
  313M32[TIGIT] vlCDR2
SASYRYT

SEQ ID NO: 4584 - protein, 9 aa, Artificial Sequence
  Description of Artificial Sequence: Synthetic peptide
  313M32[TIGIT] vlCDR3
QQHYSTPWT

SEQ ID NO: 4585 - protein, 113 aa, Artificial Sequence
  Description of Artificial Sequence: Synthetic polypeptide
  APE5137[TIM-3] variable heavy Chain
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSS

SEQ ID NO: 4586 - protein, 6 aa, Artificial Sequence
  Description of Artificial Sequence: Synthetic peptide
  APE5137[TIM-3] vhCDR1
SSYDMS

SEQ ID NO: 4587 - protein, 17 aa, Artificial Sequence
  Description of Artificial Sequence: Synthetic peptide
  APE5137[TIM-3] vhCDR2
TISGGGTYTYYQDSVKG

SEQ ID NO: 4588 - protein, 3 aa, Artificial Sequence
  Description of Artificial Sequence: Synthetic peptide
  APE5137[TIM-3] vhCDR3
MDY

SEQ ID NO: 4589 - protein, 107 aa, Artificial Sequence
  Description of Artificial Sequence: Synthetic polypeptide
  APE5137[TIM-3] variable light Chain
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIK

SEQ ID NO: 4590 - protein, 11 aa, Artificial Sequence
  Description of Artificial Sequence: Synthetic peptide
  APE5137[TIM-3] vlCDR1
RASQSIRRYLN

SEQ ID NO: 4591 - protein, 7 aa, Artificial Sequence
  Description of Artificial Sequence: Synthetic peptide
  APE5137[TIM-3] vlCDR2
GASTLQS

SEQ ID NO: 4592 - protein, 9 aa, Artificial Sequence
  Description of Artificial Sequence: Synthetic peptide
  APE5137[TIM-3] vlCDR3
QQSHSAPLT

SEQ ID NO: 4593 - protein, 119 aa, Artificial Sequence
  Description of Artificial Sequence: Synthetic polypeptide
  APE5121[TIM-3] variable heavy Chain
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSS

SEQ ID NO: 4594 - protein, 6 aa, Artificial Sequence
  Description of Artificial Sequence: Synthetic peptide
  APE5121[TIM-3] vhCDR1
GSYAMS

SEQ ID NO: 4595 - protein, 17 aa, Artificial Sequence
  Description of Artificial Sequence: Synthetic peptide
  APE5121[TIM-3] vhCDR2
AISGSGGSTYYADSVKG

SEQ ID NO: 4596 - protein, 9 aa, Artificial Sequence
  Description of Artificial Sequence: Synthetic peptide
  APE5121[TIM-3] vhCDR3
KYYVGPADY

SEQ ID NO: 4597 - protein, 113 aa, Artificial Sequence
  Description of Artificial Sequence: Synthetic polypeptide
  APE5121[TIM-3] variable light Chain
DIVMTQSPDSLAVSLGERATINCKSSQSVLYSSNNKNYLAWYQHKPGQPPKLLIYWASTRESGVPDRFSGSGSGTDFTLTISSLQAEDVAVYYCQQYYSSPLTFGGGTKIEVK

SEQ ID NO: 4598 - protein, 17 aa, Artificial Sequence
  Description of Artificial Sequence: Synthetic peptide
  APE5121[TIM-3] vlCDR1
KSSQSVLYSSNNKNYLA

SEQ ID NO: 4599 - protein, 7 aa, Artificial Sequence
  Description of Artificial Sequence: Synthetic peptide
  APE5121[TIM-3] vlCDR2
WASTRES

SEQ ID NO: 4600 - protein, 9 aa, Artificial Sequence
  Description of Artificial Sequence: Synthetic peptide
  APE5121[TIM-3] vlCDR3
QQYYSSPLT

SEQ ID NO: 4601 - protein, 118 aa, Artificial Sequence
  Description of Artificial Sequence: Synthetic polypeptide
  ABTIM3-hum03[TIM-3] variable heavy Chain
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSS

SEQ ID NO: 4602 - protein, 5 aa, Artificial Sequence
  Description of Artificial Sequence: Synthetic peptide
  ABTIM3-hum03[TIM-3] vhCDR1
SYNMH

SEQ ID NO: 4603 - protein, 17 aa, Artificial Sequence
  Description of Artificial Sequence: Synthetic peptide
  ABTIM3-hum03[TIM-3] vhCDR2
DIYPGQGDTSYNQKFKG

SEQ ID NO: 4604 - protein, 9 aa, Artificial Sequence
  Description of Artificial Sequence: Synthetic peptide
  ABTIM3-hum03[TIM-3] vhCDR3
VGGAFPMDY

SEQ ID NO: 4605 - protein, 111 aa, Artificial Sequence
  Description of Artificial Sequence: Synthetic polypeptide
  ABTIM3-hum03[TIM-3] variable light Chain
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIK

SEQ ID NO: 4606 - protein, 15 aa, Artificial Sequence
  Description of Artificial Sequence: Synthetic peptide
  ABTIM3-hum03[TIM-3] vlCDR1
RASESVEYYGTSLMQ

SEQ ID NO: 4607 - protein, 7 aa, Artificial Sequence
  Description of Artificial Sequence: Synthetic peptide
  ABTIM3-hum03[TIM-3] vlCDR2
AASNVES

SEQ ID NO: 4608 - protein, 9 aa, Artificial Sequence
  Description of Artificial Sequence: Synthetic peptide
  ABTIM3-hum03[TIM-3] vlCDR3
QQSRKDPST

SEQ ID NO: 4609 - protein, 118 aa, Artificial Sequence
  Description of Artificial Sequence: Synthetic polypeptide
  ABTIM3-hum11[TIM-3] variable heavy Chain
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSS

SEQ ID NO: 4610 - protein, 5 aa, Artificial Sequence
  Description of Artificial Sequence: Synthetic peptide
  ABTIM3-hum11[TIM-3] vhCDR1
SYNMH

SEQ ID NO: 4611 - protein, 17 aa, Artificial Sequence
  Description of Artificial Sequence: Synthetic peptide
  ABTIM3-hum11[TIM-3] vhCDR2
DIYPGNGDTSYNQKFKG

SEQ ID NO: 4612 - protein, 9 aa, Artificial Sequence
  Description of Artificial Sequence: Synthetic peptide
  ABTIM3-hum11[TIM-3] vhCDR3
VGGAFPMDY

SEQ ID NO: 4613 - protein, 111 aa, Artificial Sequence
  Description of Artificial Sequence: Synthetic polypeptide
  ABTIM3-hum11[TIM-3] variable light Chain
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIK

SEQ ID NO: 4614 - protein, 15 aa, Artificial Sequence
  Description of Artificial Sequence: Synthetic peptide
  ABTIM3-hum11[TIM-3] vlCDR1
RASESVEYYGTSLMQ

SEQ ID NO: 4615 - protein, 7 aa, Artificial Sequence
  Description of Artificial Sequence: Synthetic peptide
  ABTIM3-hum11[TIM-3] vlCDR2
AASNVES

SEQ ID NO: 4616 - protein, 9 aa, Artificial Sequence
  Description of Artificial Sequence: Synthetic peptide
  ABTIM3-hum11[TIM-3] vlCDR3
QQSRKDPST

SEQ ID NO: 4617 - protein, 118 aa, Artificial Sequence; identical to SEQ ID NO: 4601
  Description of Artificial Sequence: Synthetic polypeptide
  ABTIM3-hum21[TIM-3] variable heavy Chain

SEQ ID NO: 4618 - protein, 5 aa, Artificial Sequence
  Description of Artificial Sequence: Synthetic peptide
  ABTIM3-hum21[TIM-3] vhCDR1
SYNMH

SEQ ID NO: 4619 - protein, 17 aa, Artificial Sequence
  Description of Artificial Sequence: Synthetic peptide
  ABTIM3-hum21[TIM-3] vhCDR2
DIYPGQGDTSYNQKFKG

SEQ ID NO: 4620 - protein, 9 aa, Artificial Sequence
  Description of Artificial Sequence: Synthetic peptide
  ABTIM3-hum21[TIM-3] vhCDR3
VGGAFPMDY

SEQ ID NO: 4621 - protein, 111 aa, Artificial Sequence; identical to SEQ ID NO: 4605
  Description of Artificial Sequence: Synthetic polypeptide
  ABTIM3-hum21[TIM-3] variable light Chain

SEQ ID NO: 4622 - protein, 15 aa, Artificial Sequence
  Description of Artificial Sequence: Synthetic peptide
  ABTIM3-hum21[TIM-3] vlCDR1
RASESVEYYGTSLMQ

SEQ ID NO: 4623 - protein, 7 aa, Artificial Sequence
  Description of Artificial Sequence: Synthetic peptide
  ABTIM3-hum21[TIM-3] vlCDR2
AASNVES

SEQ ID NO: 4624 - protein, 9 aa, Artificial Sequence
  Description of Artificial Sequence: Synthetic peptide
  ABTIM3-hum21[TIM-3] vlCDR3
QQSRKDPST

SEQ ID NO: 4625 - protein, 121 aa, Artificial Sequence
  Description of Artificial Sequence: Synthetic polypeptide
  4177[TIM-3] variable heavy Chain
QVQLQESGPGLVKPSETLSLTCTVSGGSISSYYWSWIRQPPGKGLEWIGYIFHSGSTNYNPSLKSRVTISVDTSKNQFSLKLSSVTAADTAVYYCARDGEYFDMLTGFDYWGQGTLVTVSS

SEQ ID NO: 4626 - protein, 5 aa, Artificial Sequence
  Description of Artificial Sequence: Synthetic peptide
  4177[TIM-3] vhCDR1
SYYWS

SEQ ID NO: 4627 - protein, 16 aa, Artificial Sequence
  Description of Artificial Sequence: Synthetic peptide
  4177[TIM-3] vhCDR2
YIFHSGSTNYNPSLKS

SEQ ID NO: 4628 - protein, 13 aa, Artificial Sequence
  Description of Artificial Sequence: Synthetic peptide
  4177[TIM-3] vhCDR3
DGEYFDMLTGFDY

SEQ ID NO: 4629 - protein, 109 aa, Artificial Sequence
  Description of Artificial Sequence: Synthetic polypeptide
  4177[TIM-3] variable light Chain
RCDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 4630 - protein, 11 aa, Artificial Sequence
  Description of Artificial Sequence: Synthetic peptide
  4177[TIM-3] vlCDR1
RASQGISSWLA

SEQ ID NO: 4631 - protein, 7 aa, Artificial Sequence
  Description of Artificial Sequence: Synthetic peptide
  4177[TIM-3] vlCDR2
AASSLQS

SEQ ID NO: 4632 - protein, 9 aa, Artificial Sequence
  Description of Artificial Sequence: Synthetic peptide
  4177[TIM-3] vlCDR3
QQYNSYPRT

SEQ ID NO: 4633 - protein, 121 aa, Artificial Sequence
  Description of Artificial Sequence: Synthetic polypeptide
  4545[TIM-3] variable heavy Chain
QVQLQESGPGLVKPSETLSLTCTVSGGSFSRGGYYWNWIRQPPGKGLEWIGYIYYSGSTNYNPSLKSRVTISLDTSKNQFSLKLSSVTAADTAVYYCARDHYSSSWTFDYWGQGTLVTVSS

SEQ ID NO: 4634 - protein, 7 aa, Artificial Sequence
  Description of Artificial Sequence: Synthetic peptide
  4545[TIM-3] vhCDR1
RGGYYWN

SEQ ID NO: 4635 - protein, 16 aa, Artificial Sequence
  Description of Artificial Sequence: Synthetic peptide
  4545[TIM-3] vhCDR2
YIYYSGSTNYNPSLKS

SEQ ID NO: 4636 - protein, 11 aa, Artificial Sequence
  Description of Artificial Sequence: Synthetic peptide
  4545[TIM-3] vhCDR3
DHYSSSWTFDY

SEQ ID NO: 4637 - protein, 107 aa, Artificial Sequence
  Description of Artificial Sequence: Synthetic polypeptide
  4545[TIM-3] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKLEIK

SEQ ID NO: 4638 - protein, 11 aa, Artificial Sequence
  Description of Artificial Sequence: Synthetic peptide
  4545[TIM-3] vlCDR1
RASQSVSSYLA

SEQ ID NO: 4639 - protein, 7 aa, Artificial Sequence
  Description of Artificial Sequence: Synthetic peptide
  4545[TIM-3] vlCDR2
DASNRAT

SEQ ID NO: 4640 - protein, 9 aa, Artificial Sequence
  Description of Artificial Sequence: Synthetic peptide
  4545[TIM-3] vlCDR3
QQRSNWPPT

SEQ ID NO: 4641 - protein, 117 aa, Artificial Sequence
  Description of Artificial Sequence: Synthetic polypeptide
  8213[TIM-3] variable heavy Chain
QVQLVQSGAEVKKPGASVKVSCKASGYTFTSYWMHWVRQAPGQGLEWMGEINPSNGRTNYNEKFKTRVTITADTSTSTAYMELSSLRSEDTAVYYCARGYYLYFDYWGQGTLVTVSS

SEQ ID NO: 4642 - protein, 5 aa, Artificial Sequence
  Description of Artificial Sequence: Synthetic peptide
  8213[TIM-3] vhCDR1
SYWMH

SEQ ID NO: 4643 - protein, 17 aa, Artificial Sequence
  Description of Artificial Sequence: Synthetic peptide
  8213[TIM-3] vhCDR2
EINPSNGRTNYNEKFKT

SEQ ID NO: 4644 - protein, 8 aa, Artificial Sequence
  Description of Artificial Sequence: Synthetic peptide
  8213[TIM-3] vhCDR3
GYYLYFDY

SEQ ID NO: 4645 - protein, 107 aa, Artificial Sequence
  Description of Artificial Sequence: Synthetic polypeptide
  8213[TIM-3] variable light Chain
DIQMTQSPSSLSASVGDRVTITCHASQGIRINIGWYQQKPGKAPKLLIYHGTNLEDGVPSRFSGSGSGTDFTLTISSLQPEDFATYYCVQYGQFPWTFGQGTKLEIK

SEQ ID NO: 4646 - protein, 11 aa, Artificial Sequence
  Description of Artificial Sequence: Synthetic peptide
  8213[TIM-3] vlCDR1
HASQGIRINIG

SEQ ID NO: 4647 - protein, 7 aa, Artificial Sequence
  Description of Artificial Sequence: Synthetic peptide
  8213[TIM-3] vlCDR2
HGTNLED

SEQ ID NO: 4648 - protein, 9 aa, Artificial Sequence
  Description of Artificial Sequence: Synthetic peptide
  8213[TIM-3] vlCDR3
VQYGQFPWT

SEQ ID NO: 4649 - protein, 117 aa, Artificial Sequence
  Description of Artificial Sequence: Synthetic polypeptide
  mAb15[TIM-3] variable heavy Chain
QVQLKESGPGLVAPSQSLSITCTVSGFSLTGYGVTWVRQPPGKGLEWLGMIWGDGNTDYNSGLKSRLNISKDNSKSQVFLKMNSLQTDDTARYYCARSYYYGPPDYWGQGTTLTVSS

SEQ ID NO: 4650 - protein, 5 aa, Artificial Sequence
  Description of Artificial Sequence: Synthetic peptide
  mAb15[TIM-3] vhCDR1
GYGVT

SEQ ID NO: 4651 - protein, 16 aa, Artificial Sequence
  Description of Artificial Sequence: Synthetic peptide
  mAb15[TIM-3] vhCDR2
MIWGDGNTDYNSGLKS

SEQ ID NO: 4652 - protein, 9 aa, Artificial Sequence
  Description of Artificial Sequence: Synthetic peptide
  mAb15[TIM-3] vhCDR3
SYYYGPPDY

SEQ ID NO: 4653 - protein, 113 aa, Artificial Sequence
  Description of Artificial Sequence: Synthetic polypeptide
  mAb15[TIM-3] variable light Chain
DIVMTQSPSSLAMSVGQKVTMSCKSSQSLLNSRSQKNYLAWYQRKPGQSPKLLLYFASTRESGVPDRFIGSGSGTDFTLTISSVQAEDLADYFCHQHYNTPYTFGGGTKLEIK

SEQ ID NO: 4654 - protein, 17 aa, Artificial Sequence
  Description of Artificial Sequence: Synthetic peptide
  mAb15[TIM-3] vlCDR1
KSSQSLLNSRSQKNYLA

SEQ ID NO: 4655 - protein, 7 aa, Artificial Sequence
  Description of Artificial Sequence: Synthetic peptide
  mAb15[TIM-3] vlCDR2
FASTRES

SEQ ID NO: 4656 - protein, 9 aa, Artificial Sequence
  Description of Artificial Sequence: Synthetic peptide
  mAb15[TIM-3] vlCDR3
HQHYNTPYT

SEQ ID NO: 4657 - protein, 121 aa, Artificial Sequence
  Description of Artificial Sequence: Synthetic polypeptide
  mAb58[TIM-3] variable heavy Chain
QIQLVQSGPELKKPGETVKISCKASGYTFTTYGMSWVKQAPGKGLKLMGWINTYSGAPTYADDFKGRFAFSLETSASAAYLQINNLKNEDTATYFCARKPPHYYVNSFDYWGQGTTLTVSS

SEQ ID NO: 4658 - protein, 5 aa, Artificial Sequence
  Description of Artificial Sequence: Synthetic peptide
  mAb58[TIM-3] vhCDR1
TYGMS

SEQ ID NO: 4659 - protein, 17 aa, Artificial Sequence
  Description of Artificial Sequence: Synthetic peptide
  mAb58[TIM-3] vhCDR2
WINTYSGAPTYADDFKG

SEQ ID NO: 4660 - protein, 12 aa, Artificial Sequence
  Description of Artificial Sequence: Synthetic peptide
  mAb58[TIM-3] vhCDR3
KPPHYYVNSFDY

SEQ ID NO: 4661 - protein, 107 aa, Artificial Sequence
  Description of Artificial Sequence: Synthetic polypeptide
  mAb58[TIM-3] variable light Chain
DIVMTQSPATLSVTPGDRVSLSCRASQSISDYLHWYQQKSHESPRLLIKYASQSISGIPSRFSGSGSGSDFTLSINSVEPEDVGVYYCQNGHSFPYTFGGGTKLEIK

SEQ ID NO: 4662 - protein, 11 aa, Artificial Sequence
  Description of Artificial Sequence: Synthetic peptide
  mAb58[TIM-3] vlCDR1
RASQSISDYLH

SEQ ID NO: 4663 - protein, 7 aa, Artificial Sequence
  Description of Artificial Sequence: Synthetic peptide
  mAb58[TIM-3] vlCDR2
YASQSIS

SEQ ID NO: 4664 - protein, 9 aa, Artificial Sequence
  Description of Artificial Sequence: Synthetic peptide
  mAb58[TIM-3] vlCDR3
QNGHSFPYT

SEQ ID NO: 4665 - protein, 120 aa, Artificial Sequence
  Description of Artificial Sequence: Synthetic polypeptide
  TIM3-0433[TIM-3] variable heavy Chain
QITLKESGPTLVKPTQTLTLTCTFSGFSLSTSGMSVGWIRQPPGKGLEWLAHIWLNDDVFFNPALKSRLTITKDTSKNQVVLTMTNMDPVDTATYYCVRANGYLYALDYWGQGTLVTVSS

SEQ ID NO: 4666 - protein, 7 aa, Artificial Sequence
  Description of Artificial Sequence: Synthetic peptide
  TIM3-0433[TIM-3] vhCDR1
TSGMSVG

SEQ ID NO: 4667 - protein, 16 aa, Artificial Sequence
  Description of Artificial Sequence: Synthetic peptide
  TIM3-0433[TIM-3] vhCDR2
HIWLNDDVFFNPALKS

SEQ ID NO: 4668 - protein, 10 aa, Artificial Sequence
  Description of Artificial Sequence: Synthetic peptide
  TIM3-0433[TIM-3] vhCDR3
ANGYLYALDY

SEQ ID NO: 4669 - protein, 106 aa, Artificial Sequence
  Description of Artificial Sequence: Synthetic polypeptide
  TIM3-0433[TIM-3] variable light Chain
ETTLTQSPAFMSATPGDKVNIACSASSSVSYTQWYQQKPGEAPKLWIYDAFKLAPGIPPRFSGSGYGTDFTLTINNIESEDAAYYFCHQWSSYPWTFGQGTKLEIK

SEQ ID NO: 4670 - protein, 10 aa, Artificial Sequence
  Description of Artificial Sequence: Synthetic peptide
  TIM3-0433[TIM-3] vlCDR1
SASSSVSYTQ

SEQ ID NO: 4671 - protein, 7 aa, Artificial Sequence
  Description of Artificial Sequence: Synthetic peptide
  TIM3-0433[TIM-3] vlCDR2
DAFKLAP

SEQ ID NO: 4672 - protein, 9 aa, Artificial Sequence
  Description of Artificial Sequence: Synthetic peptide
  TIM3-0433[TIM-3] vlCDR3
HQWSSYPWT

SEQ ID NO: 4673 - protein, 120 aa, Artificial Sequence; identical to SEQ ID NO: 4665
  Description of Artificial Sequence: Synthetic polypeptide
  TIM3-0434[TIM-3] variable heavy Chain

SEQ ID NO: 4674 - protein, 7 aa, Artificial Sequence
  Description of Artificial Sequence: Synthetic peptide
  TIM3-0434[TIM-3] vhCDR1
TSGMSVG

SEQ ID NO: 4675 - protein, 16 aa, Artificial Sequence
  Description of Artificial Sequence: Synthetic peptide
  TIM3-0434[TIM-3] vhCDR2
HIWLNDDVFFNPALKS

SEQ ID NO: 4676 - protein, 10 aa, Artificial Sequence
  Description of Artificial Sequence: Synthetic peptide
  TIM3-0434[TIM-3] vhCDR3
ANGYLYALDY

SEQ ID NO: 4677 - protein, 106 aa, Artificial Sequence
  Description of Artificial Sequence: Synthetic polypeptide
  TIM3-0434[TIM-3] variable light Chain
DIQLTQSPSFLSASVGDRVTITCSASSSVSYTQWYQQKPGKAPKLWIYDAFKLAPGVPSRFSGSGSGTEFTLTISSLQPEDFATYFCHQWSSYPWTFGQGTKLEIK

SEQ ID NO: 4678 - protein, 10 aa, Artificial Sequence
  Description of Artificial Sequence: Synthetic peptide
  TIM3-0434[TIM-3] vlCDR1
SASSSVSYTQ

SEQ ID NO: 4679 - protein, 7 aa, Artificial Sequence
  Description of Artificial Sequence: Synthetic peptide
  TIM3-0434[TIM-3] vlCDR2
DAFKLAP

SEQ ID NO: 4680 - protein, 9 aa, Artificial Sequence
  Description of Artificial Sequence: Synthetic peptide
  TIM3-0434[TIM-3] vlCDR3
HQWSSYPWT

SEQ ID NO: 4681 - protein, 119 aa, Artificial Sequence
  Description of Artificial Sequence: Synthetic polypeptide
  TIM3-0438[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTVSS

SEQ ID NO: 4682 - protein, 5 aa, Artificial Sequence
  Description of Artificial Sequence: Synthetic peptide
  TIM3-0438[TIM-3] vhCDR1
TTYMH

SEQ ID NO: 4683 - protein, 17 aa, Artificial Sequence
  Description of Artificial Sequence: Synthetic peptide
  TIM3-0438[TIM-3] vhCDR2
RIDPADDNTKYAPKFQG

SEQ ID NO: 4684 - protein, 10 aa, Artificial Sequence
  Description of Artificial Sequence: Synthetic peptide
  TIM3-0438[TIM-3] vhCDR3
DFGYVAWFAY

SEQ ID NO: 4685 - protein, 107 aa, Artificial Sequence
  Description of Artificial Sequence: Synthetic polypeptide
  TIM3-0438[TIM-3] variable light Chain
DIVMTQSPLSLPVTPGEPASISCRASQSVDNYVAWYLQKPGQSPQLLIYYASNRYIGVPDRFSGSGSGTDFTLKISRVEAEDVGVYYCQQHYSSPYTFGQGTKVEIK

SEQ ID NO: 4686 - protein, 11 aa, Artificial Sequence
  Description of Artificial Sequence: Synthetic peptide
  TIM3-0438[TIM-3] vlCDR1
RASQSVDNYVA

SEQ ID NO: 4687 - protein, 7 aa, Artificial Sequence
  Description of Artificial Sequence: Synthetic peptide
  TIM3-0438[TIM-3] vlCDR2
YASNRYI

SEQ ID NO: 4688 - protein, 9 aa, Artificial Sequence
  Description of Artificial Sequence: Synthetic peptide
  TIM3-0438[TIM-3] vlCDR3
QQHYSSPYT

SEQ ID NO: 4689 - protein, 119 aa, Artificial Sequence
  Description of Artificial Sequence: Synthetic polypeptide
  TIM3-0443[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTFSS

SEQ ID NO: 4690 - protein, 5 aa, Artificial Sequence
  Description of Artificial Sequence: Synthetic peptide
  TIM3-0443[TIM-3] vhCDR1
TTYMH

SEQ ID NO: 4691 - protein, 17 aa, Artificial Sequence
  Description of Artificial Sequence: Synthetic peptide
  TIM3-0443[TIM-3] vhCDR2
RIDPADDNTKYAPKFQG

SEQ ID NO: 4692 - protein, 10 aa, Artificial Sequence
  Description of Artificial Sequence: Synthetic peptide
  TIM3-0443[TIM-3] vhCDR3
DFGYVAWFAY

SEQ ID NO: 4693 - protein, 107 aa, Artificial Sequence; identical to SEQ ID NO: 4685
  Description of Artificial Sequence: Synthetic polypeptide
  TIM3-0443[TIM-3] variable light Chain

SEQ ID NO: 4694 - protein, 11 aa, Artificial Sequence
  Description of Artificial Sequence: Synthetic peptide
  TIM3-0443[TIM-3] vlCDR1
RASQSVDNYVA

SEQ ID NO: 4695 - protein, 7 aa, Artificial Sequence
  Description of Artificial Sequence: Synthetic peptide
  TIM3-0443[TIM-3] vlCDR2
YASNRYI

SEQ ID NO: 4696 - protein, 9 aa, Artificial Sequence
  Description of Artificial Sequence: Synthetic peptide
  TIM3-0443[TIM-3] vlCDR3
QQHYSSPYT

SEQ ID NO: 4697 - protein, 246 aa, Artificial Sequence
  Description of Artificial Sequence: Synthetic polypeptide
  XENP019533 [CTLA-4]_H0_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4698 - protein, 118 aa, Artificial Sequence; identical to SEQ ID NO: 3737
  Description of Artificial Sequence: Synthetic polypeptide
  VH of XENP019533

SEQ ID NO: 4699 - protein, 108 aa, Artificial Sequence; identical to SEQ ID NO: 3741
  Description of Artificial Sequence: Synthetic polypeptide
  VL of XENP019533

SEQ ID NO: 4700 - protein, 5 aa, Artificial Sequence
  Description of Artificial Sequence: Synthetic peptide
  XENP019533 vhCDR1
SYTMH

SEQ ID NO: 4701 - protein, 17 aa, Artificial Sequence
  Description of Artificial Sequence: Synthetic peptide
  XENP019533 vhCDR2
FISYDGNNKYYADSVKG

SEQ ID NO: 4702 - protein, 9 aa, Artificial Sequence
  Description of Artificial Sequence: Synthetic peptide
  XENP019533 vhCDR3
TGWLGPFDY

SEQ ID NO: 4703 - protein, 12 aa, Artificial Sequence
  Description of Artificial Sequence: Synthetic peptide
  XENP019533 vlCDR1
RASQSVGSSYLA

SEQ ID NO: 4704 - protein, 7 aa, Artificial Sequence
  Description of Artificial Sequence: Synthetic peptide
  XENP019533 vlCDR2
GAFSRAT

SEQ ID NO: 4705 - protein, 9 aa, Artificial Sequence
  Description of Artificial Sequence: Synthetic peptide
  XENP019533 vlCDR3
QQYGSSPWT

SEQ ID NO: 4706 - protein, 246 aa, Artificial Sequence
  Description of Artificial Sequence: Synthetic polypeptide
  XENP019534 [CTLA-4]_H0.36_L0.50_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 4707 - protein, 118 aa, Artificial Sequence
  Description of Artificial Sequence: Synthetic polypeptide
  VH of XENP019534
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSS

SEQ ID NO: 4708 - protein, 108 aa, Artificial Sequence
  Description of Artificial Sequence: Synthetic polypeptide
  VL of XENP019534
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 4709 - protein, 5 aa, Artificial Sequence
  Description of Artificial Sequence: Synthetic peptide
  XENP019534 vhCDR1
SYTMH

SEQ ID NO: 4710 - protein, 17 aa, Artificial Sequence
  Description of Artificial Sequence: Synthetic peptide
  XENP019534 vhCDR2
FISYDGNNKYYADSVKG

SEQ ID NO: 4711 - protein, 9 aa, Artificial Sequence
  Description of Artificial Sequence: Synthetic peptide
  XENP019534 vhCDR3
TGWLGPFDY

SEQ ID NO: 4712 - protein, 12 aa, Artificial Sequence
  Description of Artificial Sequence: Synthetic peptide
  XENP019534 vlCDR1
RASQSVGSSYLA

SEQ ID NO: 4713 - protein, 7 aa, Artificial Sequence
  Description of Artificial Sequence: Synthetic peptide
  XENP019534 vlCDR2
GAFSRAT

SEQ ID NO: 4714 - protein, 9 aa, Artificial Sequence
  Description of Artificial Sequence: Synthetic peptide
  XENP019534 vlCDR3
QQYGSSPWT

SEQ ID NO: 4715 - protein, 246 aa, Artificial Sequence
  Description of Artificial Sequence: Synthetic polypeptide
  XENP019535 [CTLA-4]_H0.36_L0.51_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 4716 - protein, 118 aa, Artificial Sequence; identical to SEQ ID NO: 4707
  Description of Artificial Sequence: Synthetic polypeptide
  VH of XENP019535

SEQ ID NO: 4717 - protein, 108 aa, Artificial Sequence
  Description of Artificial Sequence: Synthetic polypeptide
  VL of XENP019535
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 4718 - protein, 5 aa, Artificial Sequence
  Description of Artificial Sequence: Synthetic peptide
  XENP019535 vhCDR1
SYTMH

SEQ ID NO: 4719 - protein, 17 aa, Artificial Sequence
  Description of Artificial Sequence: Synthetic peptide
  XENP019535 vhCDR2
FISYDGNNKYYADSVKG

SEQ ID NO: 4720 - protein, 9 aa, Artificial Sequence
  Description of Artificial Sequence: Synthetic peptide
  XENP019535 vhCDR3
TGWLGPFDY

SEQ ID NO: 4721 - protein, 12 aa, Artificial Sequence
  Description of Artificial Sequence: Synthetic peptide
  XENP019535 vlCDR1
RASQSVGSSYLA

SEQ ID NO: 4722 - protein, 7 aa, Artificial Sequence
  Description of Artificial Sequence: Synthetic peptide
  XENP019535 vlCDR2
GAFSRAT

SEQ ID NO: 4723 - protein, 9 aa, Artificial Sequence
  Description of Artificial Sequence: Synthetic peptide
  XENP019535 vlCDR3
QQYGSSPWT

SEQ ID NO: 4724 - protein, 246 aa, Artificial Sequence
  Description of Artificial Sequence: Synthetic polypeptide
  XENP019536 [CTLA-4]_H0.37_L0.50_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 4725 - protein, 118 aa, Artificial Sequence
  Description of Artificial Sequence: Synthetic polypeptide
  VH of XENP019536
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSS

SEQ ID NO: 4726 - protein, 108 aa, Artificial Sequence; identical to SEQ ID NO: 4708
  Description of Artificial Sequence: Synthetic polypeptide
  VL of XENP019536

SEQ ID NO: 4727 - protein, 5 aa, Artificial Sequence
  Description of Artificial Sequence: Synthetic peptide
  XENP019536 vhCDR1
SYTMH

SEQ ID NO: 4728 - protein, 17 aa, Artificial Sequence
  Description of Artificial Sequence: Synthetic peptide
  XENP019536 vhCDR2
FISYDGNNKYYADSVKG

SEQ ID NO: 4729 - protein, 9 aa, Artificial Sequence
  Description of Artificial Sequence: Synthetic peptide
  XENP019536 vhCDR3
TGWLGPFDY

SEQ ID NO: 4730 - protein, 12 aa, Artificial Sequence
  Description of Artificial Sequence: Synthetic peptide
  XENP019536 vlCDR1
RASQSVGSSYLA

SEQ ID NO: 4731 - protein, 7 aa, Artificial Sequence
  Description of Artificial Sequence: Synthetic peptide
  XENP019536 vlCDR2
GAFSRAT

SEQ ID NO: 4732 - protein, 9 aa, Artificial Sequence
  Description of Artificial Sequence: Synthetic peptide
  XENP019536 vlCDR3
QQYGSSPWT

SEQ ID NO: 4733 - protein, 246 aa, Artificial Sequence
  Description of Artificial Sequence: Synthetic polypeptide
  XENP019537 [CTLA-4]_H0.37_L0.113_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 4734 - protein, 118 aa, Artificial Sequence; identical to SEQ ID NO: 4725
  Description of Artificial Sequence: Synthetic polypeptide
  VH of XENP019537

SEQ ID NO: 4735 - protein, 108 aa, Artificial Sequence
  Description of Artificial Sequence: Synthetic polypeptide
  VL of XENP019537
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 4736 - protein, 5 aa, Artificial Sequence
  Description of Artificial Sequence: Synthetic peptide
  XENP019537 vhCDR1
SYTMH

SEQ ID NO: 4737 - protein, 17 aa, Artificial Sequence
  Description of Artificial Sequence: Synthetic peptide
  XENP019537 vhCDR2
FISYDGNNKYYADSVKG

SEQ ID NO: 4738 - protein, 9 aa, Artificial Sequence
  Description of Artificial Sequence: Synthetic peptide
  XENP019537 vhCDR3
TGWLGPFDY

SEQ ID NO: 4739 - protein, 12 aa, Artificial Sequence
  Description of Artificial Sequence: Synthetic peptide
  XENP019537 vlCDR1
RASQSVGSSYLA

SEQ ID NO: 4740 - protein, 7 aa, Artificial Sequence
  Description of Artificial Sequence: Synthetic peptide
  XENP019537 vlCDR2
GAFSRAT

SEQ ID NO: 4741 - protein, 9 aa, Artificial Sequence
  Description of Artificial Sequence: Synthetic peptide
  XENP019537 vlCDR3
QQYGSSPWT

SEQ ID NO: 4742 - protein, 246 aa, Artificial Sequence
  Description of Artificial Sequence: Synthetic polypeptide
  XENP019538 [CTLA-4]_H0.134_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 4743 - protein, 118 aa, Artificial Sequence
  Description of Artificial Sequence: Synthetic polypeptide
  VH of XENP019538
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSS

SEQ ID NO: 4744 - protein, 108 aa, Artificial Sequence; identical to SEQ ID NO: 4717
  Description of Artificial Sequence: Synthetic polypeptide
  VL of XENP019538

SEQ ID NO: 4745 - protein, 5 aa, Artificial Sequence
  Description of Artificial Sequence: Synthetic peptide
  XENP019538 vhCDR1
SYTMH

SEQ ID NO: 4746 - protein, 17 aa, Artificial Sequence
  Description of Artificial Sequence: Synthetic peptide
  XENP019538 vhCDR2
FISYDGNNKYYADSVKG

SEQ ID NO: 4747 - protein, 9 aa, Artificial Sequence
  Description of Artificial Sequence: Synthetic peptide
  XENP019538 vhCDR3
TGWLGPFDY

SEQ ID NO: 4748 - protein, 12 aa, Artificial Sequence
  Description of Artificial Sequence: Synthetic peptide
  XENP019538 vlCDR1
RASQSVGSSYLA

SEQ ID NO: 4749 - protein, 7 aa, Artificial Sequence
  Description of Artificial Sequence: Synthetic peptide
  XENP019538 vlCDR2
GAFSRAT

SEQ ID NO: 4750 - protein, 9 aa, Artificial Sequence
  Description of Artificial Sequence: Synthetic peptide
  XENP019538 vlCDR3
QQYGSSPWT

SEQ ID NO: 4751 - protein, 246 aa, Artificial Sequence
  Description of Artificial Sequence: Synthetic polypeptide
  XENP019539 [CTLA-4]_H0.134_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 4752 - protein, 118 aa, Artificial Sequence; identical to SEQ ID NO: 4743
  Description of Artificial Sequence: Synthetic polypeptide
  VH of XENP019539

SEQ ID NO: 4753 - protein, 108 aa, Artificial Sequence
  Description of Artificial Sequence: Synthetic polypeptide
  VL of XENP019539
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 4754 - protein, 5 aa, Artificial Sequence
  Description of Artificial Sequence: Synthetic peptide
  XENP019539 vhCDR1
SYTMH

SEQ ID NO: 4755 - protein, 17 aa, Artificial Sequence
  Description of Artificial Sequence: Synthetic peptide
  XENP019539 vhCDR2
FISYDGNNKYYADSVKG

SEQ ID NO: 4756 - protein, 9 aa, Artificial Sequence
  Description of Artificial Sequence: Synthetic peptide
  XENP019539 vhCDR3
TGWLGPFDY

SEQ ID NO: 4757 - protein, 12 aa, Artificial Sequence
  Description of Artificial Sequence: Synthetic peptide
  XENP019539 vlCDR1
RASQSVGSSYLA

SEQ ID NO: 4758 - protein, 7 aa, Artificial Sequence
  Description of Artificial Sequence: Synthetic peptide
  XENP019539 vlCDR2
GAFSRAT

SEQ ID NO: 4759 - protein, 9 aa, Artificial Sequence
  Description of Artificial Sequence: Synthetic peptide
  XENP019539 vlCDR3
QQYGSSPWT

SEQ ID NO: 4760 - protein, 246 aa, Artificial Sequence
  Description of Artificial Sequence: Synthetic polypeptide
  XENP019540 [CTLA-4]_H0.134_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 4761 - protein, 118 aa, Artificial Sequence; identical to SEQ ID NO: 4743
  Description of Artificial Sequence: Synthetic polypeptide
  VH of XENP019540

SEQ ID NO: 4762 - protein, 108 aa, Artificial Sequence
  Description of Artificial Sequence: Synthetic polypeptide
  VL of XENP019540
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 4763 - protein, 5 aa, Artificial Sequence
  Description of Artificial Sequence: Synthetic peptide
  XENP019540 vhCDR1
SYTMH

SEQ ID NO: 4764 - protein, 17 aa, Artificial Sequence
  Description of Artificial Sequence: Synthetic peptide
  XENP019540 vhCDR2
FISYDGNNKYYADSVKG

SEQ ID NO: 4765 - protein, 9 aa, Artificial Sequence
  Description of Artificial Sequence: Synthetic peptide
  XENP019540 vhCDR3
TGWLGPFDY

SEQ ID NO: 4766 - protein, 12 aa, Artificial Sequence
  Description of Artificial Sequence: Synthetic peptide
  XENP019540 vlCDR1
RASQSVGSSYLA

SEQ ID NO: 4767 - protein, 7 aa, Artificial Sequence
  Description of Artificial Sequence: Synthetic peptide
  XENP019540 vlCDR2
GAFSRAT

SEQ ID NO: 4768 - protein, 9 aa, Artificial Sequence
  Description of Artificial Sequence: Synthetic peptide
  XENP019540 vlCDR3
QQYGSSPWT

SEQ ID NO: 4769 - protein, 246 aa, Artificial Sequence
  Description of Artificial Sequence: Synthetic polypeptide
  XENP019541 [CTLA-4]_H0.137_L0.114_scFv(GKPGS)4
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 4770 - protein, 118 aa, Artificial Sequence
  Description of Artificial Sequence: Synthetic polypeptide
  VH of XENP019541
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSS

SEQ ID NO: 4771 - protein, 108 aa, Artificial Sequence
  Description of Artificial Sequence: Synthetic polypeptide
  VL of XENP019541
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 4772 - protein, 5 aa, Artificial Sequence
  Description of Artificial Sequence: Synthetic peptide
  XENP019541 vhCDR1
SYTMH

SEQ ID NO: 4773 - protein, 17 aa, Artificial Sequence
  Description of Artificial Sequence: Synthetic peptide
  XENP019541 vhCDR2
FISYDGNNKYYADSVKG

SEQ ID NO: 4774 - protein, 9 aa, Artificial Sequence
  Description of Artificial Sequence: Synthetic peptide
  XENP019541 vhCDR3
TGWLGPFDY

SEQ ID NO: 4775 - protein, 12 aa, Artificial Sequence
  Description of Artificial Sequence: Synthetic peptide
  XENP019541 vlCDR1
RASQSVGSSYLA

SEQ ID NO: 4776 - protein, 7 aa, Artificial Sequence
  Description of Artificial Sequence: Synthetic peptide
  XENP019541 vlCDR2
GAFSRAT

SEQ ID NO: 4777 - protein, 9 aa, Artificial Sequence
  Description of Artificial Sequence: Synthetic peptide
  XENP019541 vlCDR3
QQYGSSPWT

SEQ ID NO: 4778 - protein, 246 aa, Artificial Sequence
  Description of Artificial Sequence: Synthetic polypeptide
  XENP019542 [CTLA-4]_H0.138_L0.115_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 4779 - protein, 118 aa, Artificial Sequence
  Description of Artificial Sequence: Synthetic polypeptide
  VH of XENP019542
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSS

SEQ ID NO: 4780 - protein, 108 aa, Artificial Sequence
  Description of Artificial Sequence: Synthetic polypeptide
  VL of XENP019542
EIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 4781 - protein, 5 aa, Artificial Sequence
  Description of Artificial Sequence: Synthetic peptide
  XENP019542 vhCDR1
SYTMH

SEQ ID NO: 4782 - protein, 17 aa, Artificial Sequence
  Description of Artificial Sequence: Synthetic peptide
  XENP019542 vhCDR2
FISYDGNNKYYADSVKG

SEQ ID NO: 4783 - protein, 9 aa, Artificial Sequence
  Description of Artificial Sequence: Synthetic peptide
  XENP019542 vhCDR3
TGWLGPFDY

SEQ ID NO: 4784 - protein, 12 aa, Artificial Sequence
  Description of Artificial Sequence: Synthetic peptide
  XENP019542 vlCDR1
RASQSVGSSYLA

SEQ ID NO: 4785 - protein, 7 aa, Artificial Sequence
  Description of Artificial Sequence: Synthetic peptide
  XENP019542 vlCDR2
GAFSRAT

SEQ ID NO: 4786 - protein, 9 aa, Artificial Sequence
  Description of Artificial Sequence: Synthetic peptide
  XENP019542 vlCDR3
QQYGSSPWT

SEQ ID NO: 4787 - protein, 246 aa, Artificial Sequence
  Description of Artificial Sequence: Synthetic polypeptide
  XENP019543 [CTLA-4]_H0.139_L0.116_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 4788 - protein, 118 aa, Artificial Sequence; identical to SEQ ID NO: 4779
  Description of Artificial Sequence: Synthetic polypeptide
  VH of XENP019543

SEQ ID NO: 4789 - protein, 108 aa, Artificial Sequence
  Description of Artificial Sequence: Synthetic polypeptide
  VL of XENP019543
EIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 4790 - protein, 5 aa, Artificial Sequence
  Description of Artificial Sequence: Synthetic peptide
  XENP019543 vhCDR1
SYTMH

SEQ ID NO: 4791 - protein, 17 aa, Artificial Sequence
  Description of Artificial Sequence: Synthetic peptide
  XENP019543 vhCDR2
FISYDGNNKYYADSVKG

SEQ ID NO: 4792 - protein, 9 aa, Artificial Sequence
  Description of Artificial Sequence: Synthetic peptide
  XENP019543 vhCDR3
TGWLGPFDY

SEQ ID NO: 4793 - protein, 12 aa, Artificial Sequence
  Description of Artificial Sequence: Synthetic peptide
  XENP019543 vlCDR1
RASQSVGSSYLA

SEQ ID NO: 4794 - protein, 7 aa, Artificial Sequence
  Description of Artificial Sequence: Synthetic peptide
  XENP019543 vlCDR2
GAFSRAT

SEQ ID NO: 4795 - protein, 9 aa, Artificial Sequence
  Description of Artificial Sequence: Synthetic peptide
  XENP019543 vlCDR3
QQYGSSPWT

SEQ ID NO: 4796 - protein, 246 aa, Artificial Sequence
  Description of Artificial Sequence: Synthetic polypeptide
  XENP019551 [CTLA-4]_H1_L0_scFv(GKPGS)4
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4797 - protein, 118 aa, Artificial Sequence
  Description of Artificial Sequence: Synthetic polypeptide
  VH of XENP019551
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSS

SEQ ID NO: 4798 - protein, 108 aa, Artificial Sequence; identical to SEQ ID NO: 3741
  Description of Artificial Sequence: Synthetic polypeptide
  VL of XENP019551

SEQ ID NO: 4799 - protein, 5 aa, Artificial Sequence
  Description of Artificial Sequence: Synthetic peptide
  XENP019551 vhCDR1
SYTMH

SEQ ID NO: 4800 - protein, 17 aa, Artificial Sequence
  Description of Artificial Sequence: Synthetic peptide
  XENP019551 vhCDR2
FISYDGNNKYYVDSVKG

SEQ ID NO: 4801 - protein, 9 aa, Artificial Sequence
  Description of Artificial Sequence: Synthetic peptide
  XENP019551 vhCDR3
TGWLGPFDY

SEQ ID NO: 4802 - protein, 12 aa, Artificial Sequence
  Description of Artificial Sequence: Synthetic peptide
  XENP019551 vlCDR1
RASQSVGSSYLA

SEQ ID NO: 4803 - protein, 7 aa, Artificial Sequence
  Description of Artificial Sequence: Synthetic peptide
  XENP019551 vlCDR2
GAFSRAT

SEQ ID NO: 4804 - protein, 9 aa, Artificial Sequence
  Description of Artificial Sequence: Synthetic peptide
  XENP019551 vlCDR3
QQYGSSPWT

SEQ ID NO: 4805 - protein, 246 aa, Artificial Sequence
  Description of Artificial Sequence: Synthetic polypeptide
  XENP019552 [CTLA-4]_H2_L0_scFv(GKPGS)4
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4806 - protein, 118 aa, Artificial Sequence
  Description of Artificial Sequence: Synthetic polypeptide
  VH of XENP019552
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSS

SEQ ID NO: 4807 - protein, 108 aa, Artificial Sequence; identical to SEQ ID NO: 3741
  Description of Artificial Sequence: Synthetic polypeptide
  VL of XENP019552

SEQ ID NO: 4808 - protein, 5 aa, Artificial Sequence
  Description of Artificial Sequence: Synthetic peptide
  XENP019552 vhCDR1
SYTMH

SEQ ID NO: 4809 - protein, 17 aa, Artificial Sequence
  Description of Artificial Sequence: Synthetic peptide
  XENP019552 vhCDR2
FISYDGNNKYYPGSVKG

SEQ ID NO: 4810 - protein, 9 aa, Artificial Sequence
  Description of Artificial Sequence: Synthetic peptide
  XENP019552 vhCDR3
TGWLGPFDY

SEQ ID NO: 4811 - protein, 12 aa, Artificial Sequence
  Description of Artificial Sequence: Synthetic peptide
  XENP019552 vlCDR1
RASQSVGSSYLA

SEQ ID NO: 4812 - protein, 7 aa, Artificial Sequence
  Description of Artificial Sequence: Synthetic peptide
  XENP019552 vlCDR2
GAFSRAT

SEQ ID NO: 4813 - protein, 9 aa, Artificial Sequence
  Description of Artificial Sequence: Synthetic peptide
  XENP019552 vlCDR3
QQYGSSPWT

SEQ ID NO: 4814 - protein, 246 aa, Artificial Sequence
  Description of Artificial Sequence: Synthetic polypeptide
  XENP019553 [CTLA-4]_H3_L0_scFv(GKPGS)4
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4815 - protein, 118 aa, Artificial Sequence; identical to SEQ ID NO: 2405
  Description of Artificial Sequence: Synthetic polypeptide
  VH of XENP019553

SEQ ID NO: 4816 - protein, 108 aa, Artificial Sequence; identical to SEQ ID NO: 3741
  Description of Artificial Sequence: Synthetic polypeptide
  VL of XENP019553

SEQ ID NO: 4817 - protein, 5 aa, Artificial Sequence
  Description of Artificial Sequence: Synthetic peptide
  XENP019553 vhCDR1
SYTMH

SEQ ID NO: 4818 - protein, 17 aa, Artificial Sequence
  Description of Artificial Sequence: Synthetic peptide
  XENP019553 vhCDR2
FISYDGNNKYYADSVKG

SEQ ID NO: 4819 - protein, 9 aa, Artificial Sequence
  Description of Artificial Sequence: Synthetic peptide
  XENP019553 vhCDR3
TGWLGPFDY

SEQ ID NO: 4820 - protein, 12 aa, Artificial Sequence
  Description of Artificial Sequence: Synthetic peptide
  XENP019553 vlCDR1
RASQSVGSSYLA

SEQ ID NO: 4821 - protein, 7 aa, Artificial Sequence
  Description of Artificial Sequence: Synthetic peptide
  XENP019553 vlCDR2
GAFSRAT

SEQ ID NO: 4822 - protein, 9 aa, Artificial Sequence
  Description of Artificial Sequence: Synthetic peptide
  XENP019553 vlCDR3
QQYGSSPWT

SEQ ID NO: 4823 - protein, 246 aa, Artificial Sequence
  Description of Artificial Sequence: Synthetic polypeptide
  XENP019554 [CTLA-4]_H4_L0_scFv(GKPGS)4
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4824 - protein, 118 aa, Artificial Sequence
  Description of Artificial Sequence: Synthetic polypeptide
  VH of XENP019554
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSS

SEQ ID NO: 4825 - protein, 108 aa, Artificial Sequence; identical to SEQ ID NO: 3741
  Description of Artificial Sequence: Synthetic polypeptide
  VL of XENP019554

SEQ ID NO: 4826 - protein, 5 aa, Artificial Sequence
  Description of Artificial Sequence: Synthetic peptide
  XENP019554 vhCDR1
SYTMH

SEQ ID NO: 4827 - protein, 17 aa, Artificial Sequence
  Description of Artificial Sequence: Synthetic peptide
  XENP019554 vhCDR2
FISYDGNNKYYADSVKG

SEQ ID NO: 4828 - protein, 9 aa, Artificial Sequence
  Description of Artificial Sequence: Synthetic peptide
  XENP019554 vhCDR3
TGWLGPFDY

SEQ ID NO: 4829 - protein, 12 aa, Artificial Sequence
  Description of Artificial Sequence: Synthetic peptide
  XENP019554 vlCDR1
RASQSVGSSYLA

SEQ ID NO: 4830 - protein, 7 aa, Artificial Sequence
  Description of Artificial Sequence: Synthetic peptide
  XENP019554 vlCDR2
GAFSRAT

SEQ ID NO: 4831 - protein, 9 aa, Artificial Sequence
  Description of Artificial Sequence: Synthetic peptide
  XENP019554 vlCDR3
QQYGSSPWT

SEQ ID NO: 4832 - protein, 246 aa, Artificial Sequence
  Description of Artificial Sequence: Synthetic polypeptide
  XENP019555 [CTLA-4]_H0_L1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 4833 - protein, 118 aa, Artificial Sequence; identical to SEQ ID NO: 3737
  Description of Artificial Sequence: Synthetic polypeptide
  VH of XENP019555

SEQ ID NO: 4834 - protein, 108 aa, Artificial Sequence
  Description of Artificial Sequence: Synthetic polypeptide
  VL of XENP019555
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 4835 - protein, 5 aa, Artificial Sequence
  Description of Artificial Sequence: Synthetic peptide
  XENP019555 vhCDR1
SYTMH

SEQ ID NO: 4836 - protein, 17 aa, Artificial Sequence
  Description of Artificial Sequence: Synthetic peptide
  XENP019555 vhCDR2
FISYDGNNKYYADSVKG

SEQ ID NO: 4837 - protein, 9 aa, Artificial Sequence
  Description of Artificial Sequence: Synthetic peptide
  XENP019555 vhCDR3
TGWLGPFDY

SEQ ID NO: 4838 - protein, 12 aa, Artificial Sequence
  Description of Artificial Sequence: Synthetic peptide
  XENP019555 vlCDR1
GASQSVGSSYLA

SEQ ID NO: 4839 - protein, 7 aa, Artificial Sequence
  Description of Artificial Sequence: Synthetic peptide
  XENP019555 vlCDR2
GAFSRAT

SEQ ID NO: 4840 - protein, 9 aa, Artificial Sequence
  Description of Artificial Sequence: Synthetic peptide
  XENP019555 vlCDR3
QQYGSSPWT

SEQ ID NO: 4841 - protein, 246 aa, Artificial Sequence
  Description of Artificial Sequence: Synthetic polypeptide
  XENP019556 [CTLA-4]_H0_L2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 4842 - protein, 118 aa, Artificial Sequence; identical to SEQ ID NO: 3737
  Description of Artificial Sequence: Synthetic polypeptide
  VH of XENP019556

SEQ ID NO: 4843 - protein, 108 aa, Artificial Sequence
  Description of Artificial Sequence: Synthetic polypeptide
  VL of XENP019556
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 4844 - protein, 5 aa, Artificial Sequence
  Description of Artificial Sequence: Synthetic peptide
  XENP019556 vhCDR1
SYTMH

SEQ ID NO: 4845 - protein, 17 aa, Artificial Sequence
  Description of Artificial Sequence: Synthetic peptide
  XENP019556 vhCDR2
FISYDGNNKYYADSVKG

SEQ ID NO: 4846 - protein, 9 aa, Artificial Sequence
  Description of Artificial Sequence: Synthetic peptide
  XENP019556 vhCDR3
TGWLGPFDY

SEQ ID NO: 4847 - protein, 12 aa, Artificial Sequence
  Description of Artificial Sequence: Synthetic peptide
  XENP019556 vlCDR1
RASQSVGSSYLA

SEQ ID NO: 4848 - protein, 7 aa, Artificial Sequence
  Description of Artificial Sequence: Synthetic peptide
  XENP019556 vlCDR2
GAFSRAT

SEQ ID NO: 4849 - protein, 9 aa, Artificial Sequence
  Description of Artificial Sequence: Synthetic peptide
  XENP019556 vlCDR3
QQYGSSPWT

SEQ ID NO: 4850 - protein, 246 aa, Artificial Sequence
  Description of Artificial Sequence: Synthetic polypeptide
  XENP019587 [CTLA-4]_H0.140_L0_scFv(GKPGS)4
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4851 - protein, 118 aa, Artificial Sequence
  Description of Artificial Sequence: Synthetic polypeptide
  VH of XENP019587
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSS

SEQ ID NO: 4852 - protein, 108 aa, Artificial Sequence; identical to SEQ ID NO: 3741
  Description of Artificial Sequence: Synthetic polypeptide
  VL of XENP019587

SEQ ID NO: 4853 - protein, 5 aa, Artificial Sequence
  Description of Artificial Sequence: Synthetic peptide
  XENP019587 vhCDR1
SYTMH

SEQ ID NO: 4854 - protein, 17 aa, Artificial Sequence
  Description of Artificial Sequence: Synthetic peptide
  XENP019587 vhCDR2
FISYDGNNKYYADSVKG

SEQ ID NO: 4855 - protein, 9 aa, Artificial Sequence
  Description of Artificial Sequence: Synthetic peptide
  XENP019587 vhCDR3
TGWLGPFDY

SEQ ID NO: 4856 - protein, 12 aa, Artificial Sequence
  Description of Artificial Sequence: Synthetic peptide
  XENP019587 vlCDR1
RASQSVGSSYLA

SEQ ID NO: 4857 - protein, 7 aa, Artificial Sequence
  Description of Artificial Sequence: Synthetic peptide
  XENP019587 vlCDR2
GAFSRAT

SEQ ID NO: 4858 - protein, 9 aa, Artificial Sequence
  Description of Artificial Sequence: Synthetic peptide
  XENP019587 vlCDR3
QQYGSSPWT

SEQ ID NO: 4859 - protein, 246 aa, Artificial Sequence
  Description of Artificial Sequence: Synthetic polypeptide
  XENP019588 [CTLA-4]_H0_L0.117_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 4860 - protein, 118 aa, Artificial Sequence; identical to SEQ ID NO: 3737
  Description of Artificial Sequence: Synthetic polypeptide
  VH of XENP019588

SEQ ID NO: 4861 - protein, 108 aa, Artificial Sequence
  Description of Artificial Sequence: Synthetic polypeptide
  VL of XENP019588
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 4862 - protein, 5 aa, Artificial Sequence
  Description of Artificial Sequence: Synthetic peptide
  XENP019588 vhCDR1
SYTMH

SEQ ID NO: 4863 - protein, 17 aa, Artificial Sequence
  Description of Artificial Sequence: Synthetic peptide
  XENP019588 vhCDR2
FISYDGNNKYYADSVKG

SEQ ID NO: 4864 - protein, 9 aa, Artificial Sequence
  Description of Artificial Sequence: Synthetic peptide
  XENP019588 vhCDR3
TGWLGPFDY

SEQ ID NO: 4865 - protein, 12 aa, Artificial Sequence
  Description of Artificial Sequence: Synthetic peptide
  XENP019588 vlCDR1
RASQSVGSSYLA

SEQ ID NO: 4866 - protein, 7 aa, Artificial Sequence
  Description of Artificial Sequence: Synthetic peptide
  XENP019588 vlCDR2
GAFSRAT

SEQ ID NO: 4867 - protein, 9 aa, Artificial Sequence
  Description of Artificial Sequence: Synthetic peptide
  XENP019588 vlCDR3
QQYGSSPWT

SEQ ID NO: 4868 - protein, 246 aa, Artificial Sequence
  Description of Artificial Sequence: Synthetic polypeptide
  XENP019745 [CTLA-4]_H0.1_L0_scFv(GKPGS)4
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4869 - protein, 118 aa, Artificial Sequence
  Description of Artificial Sequence: Synthetic polypeptide
  VH of XENP019745
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4870 - protein, 108 aa, Artificial Sequence; identical to SEQ ID NO: 3741
  Description of Artificial Sequence: Synthetic polypeptide
  VL of XENP019745

SEQ ID NO: 4871 - protein, 5 aa, Artificial Sequence
  Description of Artificial Sequence: Synthetic peptide
  XENP019745 vhCDR1
SYTMH

SEQ ID NO: 4872 - protein, 17 aa, Artificial Sequence
  Description of Artificial Sequence: Synthetic peptide
  XENP019745 vhCDR2
FISYDGNNKYYADSVKG

SEQ ID NO: 4873 - protein, 9 aa, Artificial Sequence
  Description of Artificial Sequence: Synthetic peptide
  XENP019745 vhCDR3
TGWLGPFDY

SEQ ID NO: 4874 - protein, 12 aa, Artificial Sequence
  Description of Artificial Sequence: Synthetic peptide
  XENP019745 vlCDR1
RASQSVGSSYLA

SEQ ID NO: 4875 - protein, 7 aa, Artificial Sequence
  Description of Artificial Sequence: Synthetic peptide
  XENP019745 vlCDR2
GAFSRAT

SEQ ID NO: 4876 - protein, 9 aa, Artificial Sequence
  Description of Artificial Sequence: Synthetic peptide
  XENP019745 vlCDR3
QQYGSSPWT

SEQ ID NO: 4877 - protein, 246 aa, Artificial Sequence
  Description of Artificial Sequence: Synthetic polypeptide
  XENP019746 [CTLA-4]_H0.2_L0_scFv(GKPGS)4
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4878 - protein, 118 aa, Artificial Sequence
  Description of Artificial Sequence: Synthetic polypeptide
  VH of XENP019746
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4879 - protein, 108 aa, Artificial Sequence; identical to SEQ ID NO: 3741
  Description of Artificial Sequence: Synthetic polypeptide
  VL of XENP019746

SEQ ID NO: 4880 - protein, 5 aa, Artificial Sequence
  Description of Artificial Sequence: Synthetic peptide
  XENP019746 vhCDR1
SYTMH

SEQ ID NO: 4881 - protein, 17 aa, Artificial Sequence
  Description of Artificial Sequence: Synthetic peptide
  XENP019746 vhCDR2
FISYDGNNKYYADSVKG

SEQ ID NO: 4882 - protein, 9 aa, Artificial Sequence
  Description of Artificial Sequence: Synthetic peptide
  XENP019746 vhCDR3
TGWLGPFDY

SEQ ID NO: 4883 - protein, 12 aa, Artificial Sequence
  Description of Artificial Sequence: Synthetic peptide
  XENP019746 vlCDR1
RASQSVGSSYLA

SEQ ID NO: 4884 - protein, 7 aa, Artificial Sequence
  Description of Artificial Sequence: Synthetic peptide
  XENP019746 vlCDR2
GAFSRAT

SEQ ID NO: 4885 - protein, 9 aa, Artificial Sequence
  Description of Artificial Sequence: Synthetic peptide
  XENP019746 vlCDR3
QQYGSSPWT

SEQ ID NO: 4886 - protein, 246 aa, Artificial Sequence
  Description of Artificial Sequence: Synthetic polypeptide
  XENP019747 [CTLA-4]_H0.3_L0_scFv(GKPGS)4
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4887 - protein, 118 aa, Artificial Sequence
  Description of Artificial Sequence: Synthetic polypeptide
  VH of XENP019747
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4888 - protein, 108 aa, Artificial Sequence; identical to SEQ ID NO: 3741
  Description of Artificial Sequence: Synthetic polypeptide
  VL of XENP019747

SEQ ID NO: 4889 - protein, 5 aa, Artificial Sequence
  Description of Artificial Sequence: Synthetic peptide
  XENP019747 vhCDR1
SYTMH

SEQ ID NO: 4890 - protein, 17 aa, Artificial Sequence
  Description of Artificial Sequence: Synthetic peptide
  XENP019747 vhCDR2
FISYDGNNKYYADSVKG

SEQ ID NO: 4891 - protein, 9 aa, Artificial Sequence
  Description of Artificial Sequence: Synthetic peptide
  XENP019747 vhCDR3
TGWLGPFDY

SEQ ID NO: 4892 - protein, 12 aa, Artificial Sequence
  Description of Artificial Sequence: Synthetic peptide
  XENP019747 vlCDR1
RASQSVGSSYLA

SEQ ID NO: 4893 - protein, 7 aa, Artificial Sequence
  Description of Artificial Sequence: Synthetic peptide
  XENP019747 vlCDR2
GAFSRAT

SEQ ID NO: 4894 - protein, 9 aa, Artificial Sequence
  Description of Artificial Sequence: Synthetic peptide
  XENP019747 vlCDR3
QQYGSSPWT

SEQ ID NO: 4895 - protein, 246 aa, Artificial Sequence
  Description of Artificial Sequence: Synthetic polypeptide
  XENP019748 [CTLA-4]_H0.4_L0_scFv(GKPGS)4
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4896 - protein, 118 aa, Artificial Sequence
  Description of Artificial Sequence: Synthetic polypeptide
  VH of XENP019748
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4897 - protein, 108 aa, Artificial Sequence; identical to SEQ ID NO: 3741
  Description of Artificial Sequence: Synthetic polypeptide
  VL of XENP019748

SEQ ID NO: 4898 - protein, 5 aa, Artificial Sequence
  Description of Artificial Sequence: Synthetic peptide
  XENP019748 vhCDR1
SYTMH

SEQ ID NO: 4899 - protein, 17 aa, Artificial Sequence
  Description of Artificial Sequence: Synthetic peptide
  XENP019748 vhCDR2
FISYDGNNKYYADSVKG

SEQ ID NO: 4900 - protein, 9 aa, Artificial Sequence
  Description of Artificial Sequence: Synthetic peptide
  XENP019748 vhCDR3
TGWLGPFDY

SEQ ID NO: 4901 - protein, 12 aa, Artificial Sequence
  Description of Artificial Sequence: Synthetic peptide
  XENP019748 vlCDR1
RASQSVGSSYLA

SEQ ID NO: 4902 - protein, 7 aa, Artificial Sequence
  Description of Artificial Sequence: Synthetic peptide
  XENP019748 vlCDR2
GAFSRAT

SEQ ID NO: 4903 - protein, 9 aa, Artificial Sequence
  Description of Artificial Sequence: Synthetic peptide
  XENP019748 vlCDR3
QQYGSSPWT

SEQ ID NO: 4904 - protein, 246 aa, Artificial Sequence
  Description of Artificial Sequence: Synthetic polypeptide
  XENP019749 [CTLA-4]_H0.5_L0_scFv(GKPGS)4
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4905 - protein, 118 aa, Artificial Sequence
  Description of Artificial Sequence: Synthetic polypeptide
  VH of XENP019749
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4906 - protein, 108 aa, Artificial Sequence; identical to SEQ ID NO: 3741
  Description of Artificial Sequence: Synthetic polypeptide
  VL of XENP019749

SEQ ID NO: 4907 - protein, 5 aa, Artificial Sequence
  Description of Artificial Sequence: Synthetic peptide
  XENP019749 vhCDR1
SYTMH

SEQ ID NO: 4908 - protein, 17 aa, Artificial Sequence
  Description of Artificial Sequence: Synthetic peptide
  XENP019749 vhCDR2
FISYDGNNKYYADSVKG

SEQ ID NO: 4909 - protein, 9 aa, Artificial Sequence
  Description of Artificial Sequence: Synthetic peptide
  XENP019749 vhCDR3
TGWLGPFDY

SEQ ID NO: 4910 - protein, 12 aa, Artificial Sequence
  Description of Artificial Sequence: Synthetic peptide
  XENP019749 vlCDR1
RASQSVGSSYLA

SEQ ID NO: 4911 - protein, 7 aa, Artificial Sequence
  Description of Artificial Sequence: Synthetic peptide
  XENP019749 vlCDR2
GAFSRAT

SEQ ID NO: 4912 - protein, 9 aa, Artificial Sequence
  Description of Artificial Sequence: Synthetic peptide
  XENP019749 vlCDR3
QQYGSSPWT

SEQ ID NO: 4913 - protein, 246 aa, Artificial Sequence
  Description of Artificial Sequence: Synthetic polypeptide
  XENP019750 [CTLA-4]_H0.6_L0_scFv(GKPGS)4
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4914 - protein, 118 aa, Artificial Sequence
  Description of Artificial Sequence: Synthetic polypeptide
  VH of XENP019750
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4915 - protein, 108 aa, Artificial Sequence; identical to SEQ ID NO: 3741
  Description of Artificial Sequence: Synthetic polypeptide
  VL of XENP019750

SEQ ID NO: 4916 - protein, 5 aa, Artificial Sequence
  Description of Artificial Sequence: Synthetic peptide
  XENP019750 vhCDR1
SYTMH

SEQ ID NO: 4917 - protein, 17 aa, Artificial Sequence
  Description of Artificial Sequence: Synthetic peptide
  XENP019750 vhCDR2
FISYDGNNKYYADSVKG

SEQ ID NO: 4918 - protein, 9 aa, Artificial Sequence
  Description of Artificial Sequence: Synthetic peptide
  XENP019750 vhCDR3
TGWLGPFDY

SEQ ID NO: 4919 - protein, 12 aa, Artificial Sequence
  Description of Artificial Sequence: Synthetic peptide
  XENP019750 vlCDR1
RASQSVGSSYLA

SEQ ID NO: 4920 - protein, 7 aa, Artificial Sequence
  Description of Artificial Sequence: Synthetic peptide
  XENP019750 vlCDR2
GAFSRAT

SEQ ID NO: 4921 - protein, 9 aa, Artificial Sequence
  Description of Artificial Sequence: Synthetic peptide
  XENP019750 vlCDR3
QQYGSSPWT

SEQ ID NO: 4922 - protein, 246 aa, Artificial Sequence
  Description of Artificial Sequence: Synthetic polypeptide
  XENP019751 [CTLA-4]_H0.7_L0_scFv(GKPGS)4
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4923 - protein, 118 aa, Artificial Sequence
  Description of Artificial Sequence: Synthetic polypeptide
  VH of XENP019751
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4924 - protein, 108 aa, Artificial Sequence; identical to SEQ ID NO: 3741
  Description of Artificial Sequence: Synthetic polypeptide
  VL of XENP019751

SEQ ID NO: 4925 - protein, 5 aa, Artificial Sequence
  Description of Artificial Sequence: Synthetic peptide
  XENP019751 vhCDR1
SYTMH

SEQ ID NO: 4926 - protein, 17 aa, Artificial Sequence
  Description of Artificial Sequence: Synthetic peptide
  XENP019751 vhCDR2
FISYDGNNKYYADSVKG

SEQ ID NO: 4927 - protein, 9 aa, Artificial Sequence
  Description of Artificial Sequence: Synthetic peptide
  XENP019751 vhCDR3
TGWLGPFDY

SEQ ID NO: 4928 - protein, 12 aa, Artificial Sequence
  Description of Artificial Sequence: Synthetic peptide
  XENP019751 vlCDR1
RASQSVGSSYLA

SEQ ID NO: 4929 - protein, 7 aa, Artificial Sequence
  Description of Artificial Sequence: Synthetic peptide
  XENP019751 vlCDR2
GAFSRAT

SEQ ID NO: 4930 - protein, 9 aa, Artificial Sequence
  Description of Artificial Sequence: Synthetic peptide
  XENP019751 vlCDR3
QQYGSSPWT

SEQ ID NO: 4931 - protein, 246 aa, Artificial Sequence
  Description of Artificial Sequence: Synthetic polypeptide
  XENP019752 [CTLA-4]_H0.8_L0_scFv(GKPGS)4
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4932 - protein, 118 aa, Artificial Sequence
  Description of Artificial Sequence: Synthetic polypeptide
  VH of XENP019752
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4933 - protein, 108 aa, Artificial Sequence; identical to SEQ ID NO: 3741
  Description of Artificial Sequence: Synthetic polypeptide
  VL of XENP019752

SEQ ID NO: 4934 - protein, 5 aa, Artificial Sequence
  Description of Artificial Sequence: Synthetic peptide
  XENP019752 vhCDR1
SYTMH

SEQ ID NO: 4935 - protein, 17 aa, Artificial Sequence
  Description of Artificial Sequence: Synthetic peptide
  XENP019752 vhCDR2
FISYDGNNKYYADSVKG

SEQ ID NO: 4936 - protein, 9 aa, Artificial Sequence
  Description of Artificial Sequence: Synthetic peptide
  XENP019752 vhCDR3
TGWLGPFDY

SEQ ID NO: 4937 - protein, 12 aa, Artificial Sequence
  Description of Artificial Sequence: Synthetic peptide
  XENP019752 vlCDR1
RASQSVGSSYLA

SEQ ID NO: 4938 - protein, 7 aa, Artificial Sequence
  Description of Artificial Sequence: Synthetic peptide
  XENP019752 vlCDR2
GAFSRAT

SEQ ID NO: 4939 - protein, 9 aa, Artificial Sequence
  Description of Artificial Sequence: Synthetic peptide
  XENP019752 vlCDR3
QQYGSSPWT

SEQ ID NO: 4940 - protein, 246 aa, Artificial Sequence
  Description of Artificial Sequence: Synthetic polypeptide
  XENP019753 [CTLA-4]_H0.9_L0_scFv(GKPGS)4
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4941 - protein, 118 aa, Artificial Sequence
  Description of Artificial Sequence: Synthetic polypeptide
  VH of XENP019753
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4942 - protein, 108 aa, Artificial Sequence; identical to SEQ ID NO: 3741
  Description of Artificial Sequence: Synthetic polypeptide
  VL of XENP019753

SEQ ID NO: 4943 - protein, 5 aa, Artificial Sequence
  Description of Artificial Sequence: Synthetic peptide
  XENP019753 vhCDR1
SYTMH

SEQ ID NO: 4944 - protein, 17 aa, Artificial Sequence
  Description of Artificial Sequence: Synthetic peptide
  XENP019753 vhCDR2
FISYDGNNKYYADSVKG

SEQ ID NO: 4945 - protein, 9 aa, Artificial Sequence
  Description of Artificial Sequence: Synthetic peptide
  XENP019753 vhCDR3
TGWLGPFDY

SEQ ID NO: 4946 - protein, 12 aa, Artificial Sequence
  Description of Artificial Sequence: Synthetic peptide
  XENP019753 vlCDR1
RASQSVGSSYLA

SEQ ID NO: 4947 - protein, 7 aa, Artificial Sequence
  Description of Artificial Sequence: Synthetic peptide
  XENP019753 vlCDR2
GAFSRAT

SEQ ID NO: 4948 - protein, 9 aa, Artificial Sequence
  Description of Artificial Sequence: Synthetic peptide
  XENP019753 vlCDR3
QQYGSSPWT

SEQ ID NO: 4949 - protein, 246 aa, Artificial Sequence
  Description of Artificial Sequence: Synthetic polypeptide
  XENP019754 [CTLA-4]_H0.10_L0_scFv(GKPGS)4
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4950 - protein, 118 aa, Artificial Sequence
  Description of Artificial Sequence: Synthetic polypeptide
  VH of XENP019754
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4951 - protein, 108 aa, Artificial Sequence; identical to SEQ ID NO: 3741
  Description of Artificial Sequence: Synthetic polypeptide
  VL of XENP019754

SEQ ID NO: 4952 - protein, 5 aa, Artificial Sequence
  Description of Artificial Sequence: Synthetic peptide
  XENP019754 vhCDR1
SYTMH

SEQ ID NO: 4953 - protein, 17 aa, Artificial Sequence
  Description of Artificial Sequence: Synthetic peptide
  XENP019754 vhCDR2
FISYDGNNKYYADSVKG

SEQ ID NO: 4954 - protein, 9 aa, Artificial Sequence
  Description of Artificial Sequence: Synthetic peptide
  XENP019754 vhCDR3
TGWLGPFDY

SEQ ID NO: 4955 - protein, 12 aa, Artificial Sequence
  Description of Artificial Sequence: Synthetic peptide
  XENP019754 vlCDR1
RASQSVGSSYLA

SEQ ID NO: 4956 - protein, 7 aa, Artificial Sequence
  Description of Artificial Sequence: Synthetic peptide
  XENP019754 vlCDR2
GAFSRAT

SEQ ID NO: 4957 - protein, 9 aa, Artificial Sequence
  Description of Artificial Sequence: Synthetic peptide
  XENP019754 vlCDR3
QQYGSSPWT

SEQ ID NO: 4958 - protein, 246 aa, Artificial Sequence
  Description of Artificial Sequence: Synthetic polypeptide
  XENP019755 [CTLA-4]_H0.11_L0_scFv(GKPGS)4
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4959 - protein, 118 aa, Artificial Sequence
  Description of Artificial Sequence: Synthetic polypeptide
  VH of XENP019755
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4960 - protein, 108 aa, Artificial Sequence; identical to SEQ ID NO: 3741
  Description of Artificial Sequence: Synthetic polypeptide
  VL of XENP019755

SEQ ID NO: 4961 - protein, 5 aa, Artificial Sequence
  Description of Artificial Sequence: Synthetic peptide
  XENP019755 vhCDR1
SYTMH

SEQ ID NO: 4962 - protein, 17 aa, Artificial Sequence
  Description of Artificial Sequence: Synthetic peptide
  XENP019755 vhCDR2
FISYDGNNKYYADSVKG

SEQ ID NO: 4963 - protein, 9 aa, Artificial Sequence
  Description of Artificial Sequence: Synthetic peptide
  XENP019755 vhCDR3
TGWLGPFDY

SEQ ID NO: 4964 - protein, 12 aa, Artificial Sequence
  Description of Artificial Sequence: Synthetic peptide
  XENP019755 vlCDR1
RASQSVGSSYLA

SEQ ID NO: 4965 - protein, 7 aa, Artificial Sequence
  Description of Artificial Sequence: Synthetic peptide
  XENP019755 vlCDR2
GAFSRAT

SEQ ID NO: 4966 - protein, 9 aa, Artificial Sequence
  Description of Artificial Sequence: Synthetic peptide
  XENP019755 vlCDR3
QQYGSSPWT

SEQ ID NO: 4967 - protein, 246 aa, Artificial Sequence
  Description of Artificial Sequence: Synthetic polypeptide
  XENP019756 [CTLA-4]_H0.12_L0_scFv(GKPGS)4
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4968 - protein, 118 aa, Artificial Sequence
  Description of Artificial Sequence: Synthetic polypeptide
  VH of XENP019756
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4969 - protein, 108 aa, Artificial Sequence; identical to SEQ ID NO: 3741
  Description of Artificial Sequence: Synthetic polypeptide
  VL of XENP019756

SEQ ID NO: 4970 - protein, 5 aa, Artificial Sequence
  Description of Artificial Sequence: Synthetic peptide
  XENP019756 vhCDR1
AYTMH

SEQ ID NO: 4971 - protein, 17 aa, Artificial Sequence
  Description of Artificial Sequence: Synthetic peptide
  XENP019756 vhCDR2
FISYDGNNKYYADSVKG

SEQ ID NO: 4972 - protein, 9 aa, Artificial Sequence
  Description of Artificial Sequence: Synthetic peptide
  XENP019756 vhCDR3
TGWLGPFDY

SEQ ID NO: 4973 - protein, 12 aa, Artificial Sequence
  Description of Artificial Sequence: Synthetic peptide
  XENP019756 vlCDR1
RASQSVGSSYLA

SEQ ID NO: 4974 - protein, 7 aa, Artificial Sequence
  Description of Artificial Sequence: Synthetic peptide
  XENP019756 vlCDR2
GAFSRAT

SEQ ID NO: 4975 - protein, 9 aa, Artificial Sequence
  Description of Artificial Sequence: Synthetic peptide
  XENP019756 vlCDR3
QQYGSSPWT

SEQ ID NO: 4976 - protein, 246 aa, Artificial Sequence
  Description of Artificial Sequence: Synthetic polypeptide
  XENP019757 [CTLA-4]_H0.13_L0_scFv(GKPGS)4
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4977 - protein, 118 aa, Artificial Sequence
  Description of Artificial Sequence: Synthetic polypeptide
  VH of XENP019757
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4978 - protein, 108 aa, Artificial Sequence; identical to SEQ ID NO: 3741
  Description of Artificial Sequence: Synthetic polypeptide
  VL of XENP019757

SEQ ID NO: 4979 - protein, 5 aa, Artificial Sequence
  Description of Artificial Sequence: Synthetic peptide
  XENP019757 vhCDR1
DYTMH

SEQ ID NO: 4980 - protein, 17 aa, Artificial Sequence
  Description of Artificial Sequence: Synthetic peptide
  XENP019757 vhCDR2
FISYDGNNKYYADSVKG

SEQ ID NO: 4981 - protein, 9 aa, Artificial Sequence
  Description of Artificial Sequence: Synthetic peptide
  XENP019757 vhCDR3
TGWLGPFDY

SEQ ID NO: 4982 - protein, 12 aa, Artificial Sequence
  Description of Artificial Sequence: Synthetic peptide
  XENP019757 vlCDR1
RASQSVGSSYLA

SEQ ID NO: 4983 - protein, 7 aa, Artificial Sequence
  Description of Artificial Sequence: Synthetic peptide
  XENP019757 vlCDR2
GAFSRAT

SEQ ID NO: 4984 - protein, 9 aa, Artificial Sequence
  Description of Artificial Sequence: Synthetic peptide
  XENP019757 vlCDR3
QQYGSSPWT

SEQ ID NO: 4985 - protein, 246 aa, Artificial Sequence
  Description of Artificial Sequence: Synthetic polypeptide
  XENP019758 [CTLA-4]_H0.14_L0_scFv(GKPGS)4
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4986 - protein, 118 aa, Artificial Sequence
  Description of Artificial Sequence: Synthetic polypeptide
  VH of XENP019758
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4987 - protein, 108 aa, Artificial Sequence; identical to SEQ ID NO: 3741
  Description of Artificial Sequence: Synthetic polypeptide
  VL of XENP019758

SEQ ID NO: 4988 - protein, 5 aa, Artificial Sequence
  Description of Artificial Sequence: Synthetic peptide
  XENP019758 vhCDR1
GYTMH

SEQ ID NO: 4989 - protein, 17 aa, Artificial Sequence
  Description of Artificial Sequence: Synthetic peptide
  XENP019758 vhCDR2
FISYDGNNKYYADSVKG

SEQ ID NO: 4990 - protein, 9 aa, Artificial Sequence
  Description of Artificial Sequence: Synthetic peptide
  XENP019758 vhCDR3
TGWLGPFDY

SEQ ID NO: 4991 - protein, 12 aa, Artificial Sequence
  Description of Artificial Sequence: Synthetic peptide
  XENP019758 vlCDR1
RASQSVGSSYLA

SEQ ID NO: 4992 - protein, 7 aa, Artificial Sequence
  Description of Artificial Sequence: Synthetic peptide
  XENP019758 vlCDR2
GAFSRAT

SEQ ID NO: 4993 - protein, 9 aa, Artificial Sequence
  Description of Artificial Sequence: Synthetic peptide
  XENP019758 vlCDR3
QQYGSSPWT

SEQ ID NO: 4994 - protein, 246 aa, Artificial Sequence
  Description of Artificial Sequence: Synthetic polypeptide
  XENP019759 [CTLA-4]_H0.15_L0_scFv(GKPGS)4
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 4995 - protein, 118 aa, Artificial Sequence
  Description of Artificial Sequence: Synthetic polypeptide
  VH of XENP019759
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 4996 - protein, 108 aa, Artificial Sequence; identical to SEQ ID NO: 3741
  Description of Artificial Sequence: Synthetic polypeptide
  VL of XENP019759

SEQ ID NO: 4997 - protein, 5 aa, Artificial Sequence
  Description of Artificial Sequence: Synthetic peptide
  XENP019759 vhCDR1
NYTMH

SEQ ID NO: 4998 - protein, 17 aa, Artificial Sequence
  Description of Artificial Sequence: Synthetic peptide
  XENP019759 vhCDR2
FISYDGNNKYYADSVKG

SEQ ID NO: 4999 - protein, 9 aa, Artificial Sequence
  Description of Artificial Sequence: Synthetic peptide
  XENP019759 vhCDR3
TGWLGPFDY

SEQ ID NO: 5000 - protein, 12 aa, Artificial Sequence
  Description of Artificial Sequence: Synthetic peptide
  XENP019759 vlCDR1
RASQSVGSSYLA

SEQ ID NO: 5001 - protein, 7 aa, Artificial Sequence
  Description of Artificial Sequence: Synthetic peptide
  XENP019759 vlCDR2
GAFSRAT

SEQ ID NO: 5002 - protein, 9 aa, Artificial Sequence
  Description of Artificial Sequence: Synthetic peptide
  XENP019759 vlCDR3
QQYGSSPWT

SEQ ID NO: 5003 - protein, 246 aa, Artificial Sequence
  Description of Artificial Sequence: Synthetic polypeptide
  XENP019760 [CTLA-4]_H0.16_L0_scFv(GKPGS)4
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5004 - protein, 118 aa, Artificial Sequence
  Description of Artificial Sequence: Synthetic polypeptide
  VH of XENP019760
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5005 - protein, 108 aa, Artificial Sequence; identical to SEQ ID NO: 3741
  Description of Artificial Sequence: Synthetic polypeptide
  VL of XENP019760

SEQ ID NO: 5006 - protein, 5 aa, Artificial Sequence
  Description of Artificial Sequence: Synthetic peptide
  XENP019760 vhCDR1
QYTMH

SEQ ID NO: 5007 - protein, 17 aa, Artificial Sequence
  Description of Artificial Sequence: Synthetic peptide
  XENP019760 vhCDR2
FISYDGNNKYYADSVKG

SEQ ID NO: 5008 - protein, 9 aa, Artificial Sequence
  Description of Artificial Sequence: Synthetic peptide
  XENP019760 vhCDR3
TGWLGPFDY

SEQ ID NO: 5009 - protein, 12 aa, Artificial Sequence
  Description of Artificial Sequence: Synthetic peptide
  XENP019760 vlCDR1
RASQSVGSSYLA

SEQ ID NO: 5010 - protein, 7 aa, Artificial Sequence
  Description of Artificial Sequence: Synthetic peptide
  XENP019760 vlCDR2
GAFSRAT

SEQ ID NO: 5011 - protein, 9 aa, Artificial Sequence
  Description of Artificial Sequence: Synthetic peptide
  XENP019760 vlCDR3
QQYGSSPWT

SEQ ID NO: 5012 - protein, 246 aa, Artificial Sequence
  Description of Artificial Sequence: Synthetic polypeptide
  XENP019761 [CTLA-4]_H0.17_L0_scFv(GKPGS)4
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5013 - protein, 118 aa, Artificial Sequence
  Description of Artificial Sequence: Synthetic polypeptide
  VH of XENP019761
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5014 - protein, 108 aa, Artificial Sequence; identical to SEQ ID NO: 3741
  Description of Artificial Sequence: Synthetic polypeptide
  VL of XENP019761

SEQ ID NO: 5015 - protein, 5 aa, Artificial Sequence
  Description of Artificial Sequence: Synthetic peptide
  XENP019761 vhCDR1
TYTMH

SEQ ID NO: 5016 - protein, 17 aa, Artificial Sequence
  Description of Artificial Sequence: Synthetic peptide
  XENP019761 vhCDR2
FISYDGNNKYYADSVKG

SEQ ID NO: 5017 - protein, 9 aa, Artificial Sequence
  Description of Artificial Sequence: Synthetic peptide
  XENP019761 vhCDR3
TGWLGPFDY

SEQ ID NO: 5018 - protein, 12 aa, Artificial Sequence
  Description of Artificial Sequence: Synthetic peptide
  XENP019761 vlCDR1
RASQSVGSSYLA

SEQ ID NO: 5019 - protein, 7 aa, Artificial Sequence
  Description of Artificial Sequence: Synthetic peptide
  XENP019761 vlCDR2
GAFSRAT

SEQ ID NO: 5020 - protein, 9 aa, Artificial Sequence
  Description of Artificial Sequence: Synthetic peptide
  XENP019761 vlCDR3
QQYGSSPWT

SEQ ID NO: 5021 - protein, 246 aa, Artificial Sequence
  Description of Artificial Sequence: Synthetic polypeptide
  XENP019762 [CTLA-4]_H0.18_L0_scFv(GKPGS)4
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5022 - protein, 118 aa, Artificial Sequence
  Description of Artificial Sequence: Synthetic polypeptide
  VH of XENP019762
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5023 - protein, 108 aa, Artificial Sequence; identical to SEQ ID NO: 3741
  Description of Artificial Sequence: Synthetic polypeptide
  VL of XENP019762

SEQ ID NO: 5024 - protein, 5 aa, Artificial Sequence
  Description of Artificial Sequence: Synthetic peptide
  XENP019762 vhCDR1
SATMH

SEQ ID NO: 5025 - protein, 17 aa, Artificial Sequence
  Description of Artificial Sequence: Synthetic peptide
  XENP019762 vhCDR2
FISYDGNNKYYADSVKG

SEQ ID NO: 5026 - protein, 9 aa, Artificial Sequence
  Description of Artificial Sequence: Synthetic peptide
  XENP019762 vhCDR3
TGWLGPFDY

SEQ ID NO: 5027 - protein, 12 aa, Artificial Sequence
  Description of Artificial Sequence: Synthetic peptide
  XENP019762 vlCDR1
RASQSVGSSYLA

SEQ ID NO: 5028 - protein, 7 aa, Artificial Sequence
  Description of Artificial Sequence: Synthetic peptide
  XENP019762 vlCDR2
GAFSRAT

SEQ ID NO: 5029 - protein, 9 aa, Artificial Sequence
  Description of Artificial Sequence: Synthetic peptide
  XENP019762 vlCDR3
QQYGSSPWT

SEQ ID NO: 5030 - protein, 246 aa, Artificial Sequence
  Description of Artificial Sequence: Synthetic polypeptide
  XENP019763 [CTLA-4]_H0.19_L0_scFv(GKPGS)4
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5031 - protein, 118 aa, Artificial Sequence
  Description of Artificial Sequence: Synthetic polypeptide
  VH of XENP019763
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5032 - protein, 108 aa, Artificial Sequence; identical to SEQ ID NO: 3741
  Description of Artificial Sequence: Synthetic polypeptide
  VL of XENP019763

SEQ ID NO: 5033 - protein, 5 aa, Artificial Sequence
  Description of Artificial Sequence: Synthetic peptide
  XENP019763 vhCDR1
SHTMH

SEQ ID NO: 5034 - protein, 17 aa, Artificial Sequence
  Description of Artificial Sequence: Synthetic peptide
  XENP019763 vhCDR2
FISYDGNNKYYADSVKG

SEQ ID NO: 5035 - protein, 9 aa, Artificial Sequence
  Description of Artificial Sequence: Synthetic peptide
  XENP019763 vhCDR3
TGWLGPFDY

SEQ ID NO: 5036 - protein, 12 aa, Artificial Sequence
  Description of Artificial Sequence: Synthetic peptide
  XENP019763 vlCDR1
RASQSVGSSYLA

SEQ ID NO: 5037 - protein, 7 aa, Artificial Sequence
  Description of Artificial Sequence: Synthetic peptide
  XENP019763 vlCDR2
GAFSRAT

SEQ ID NO: 5038 - protein, 9 aa, Artificial Sequence
  Description of Artificial Sequence: Synthetic peptide
  XENP019763 vlCDR3
QQYGSSPWT

SEQ ID NO: 5039 - protein, 246 aa, Artificial Sequence
  Description of Artificial Sequence: Synthetic polypeptide
  XENP019764 [CTLA-4]_H0.20_L0_scFv(GKPGS)4
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5040 - protein, 118 aa, Artificial Sequence
  Description of Artificial Sequence: Synthetic polypeptide
  VH of XENP019764
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5041 - protein, 108 aa, Artificial Sequence; identical to SEQ ID NO: 3741
  Description of Artificial Sequence: Synthetic polypeptide
  VL of XENP019764

SEQ ID NO: 5042 - protein, 5 aa, Artificial Sequence
  Description of Artificial Sequence: Synthetic peptide
  XENP019764 vhCDR1
SFTMH

SEQ ID NO: 5043 - protein, 17 aa, Artificial Sequence
  Description of Artificial Sequence: Synthetic peptide
  XENP019764 vhCDR2
FISYDGNNKYYADSVKG

SEQ ID NO: 5044 - protein, 9 aa, Artificial Sequence
  Description of Artificial Sequence: Synthetic peptide
  XENP019764 vhCDR3
TGWLGPFDY

SEQ ID NO: 5045 - protein, 12 aa, Artificial Sequence
  Description of Artificial Sequence: Synthetic peptide
  XENP019764 vlCDR1
RASQSVGSSYLA

SEQ ID NO: 5046 - protein, 7 aa, Artificial Sequence
  Description of Artificial Sequence: Synthetic peptide
  XENP019764 vlCDR2
GAFSRAT

SEQ ID NO: 5047 - protein, 9 aa, Artificial Sequence
  Description of Artificial Sequence: Synthetic peptide
  XENP019764 vlCDR3
QQYGSSPWT

SEQ ID NO: 5048 - protein, 246 aa, Artificial Sequence
  Description of Artificial Sequence: Synthetic polypeptide
  XENP019765 [CTLA-4]_H0.21_L0_scFv(GKPGS)4
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5049 - protein, 118 aa, Artificial Sequence
  Description of Artificial Sequence: Synthetic polypeptide
  VH of XENP019765
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5050 - protein, 108 aa, Artificial Sequence; identical to SEQ ID NO: 3741
  Description of Artificial Sequence: Synthetic polypeptide
  VL of XENP019765

SEQ ID NO: 5051 - protein, 5 aa, Artificial Sequence
  Description of Artificial Sequence: Synthetic peptide
  XENP019765 vhCDR1
SLTMH

SEQ ID NO: 5052 - protein, 17 aa, Artificial Sequence
  Description of Artificial Sequence: Synthetic peptide
  XENP019765 vhCDR2
FISYDGNNKYYADSVKG

SEQ ID NO: 5053 - protein, 9 aa, Artificial Sequence
  Description of Artificial Sequence: Synthetic peptide
  XENP019765 vhCDR3
TGWLGPFDY

SEQ ID NO: 5054 - protein, 12 aa, Artificial Sequence
  Description of Artificial Sequence: Synthetic peptide
  XENP019765 vlCDR1
RASQSVGSSYLA

SEQ ID NO: 5055 - protein, 7 aa, Artificial Sequence
  Description of Artificial Sequence: Synthetic peptide
  XENP019765 vlCDR2
GAFSRAT

SEQ ID NO: 5056 - protein, 9 aa, Artificial Sequence
  Description of Artificial Sequence: Synthetic peptide
  XENP019765 vlCDR3
QQYGSSPWT

SEQ ID NO: 5057 - protein, 246 aa, Artificial Sequence
  Description of Artificial Sequence: Synthetic polypeptide
  XENP019766 [CTLA-4]_H0.22_L0_scFv(GKPGS)4
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5058 - protein, 118 aa, Artificial Sequence
  Description of Artificial Sequence: Synthetic polypeptide
  VH of XENP019766
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5059 - protein, 108 aa, Artificial Sequence; identical to SEQ ID NO: 3741
  Description of Artificial Sequence: Synthetic polypeptide
  VL of XENP019766

SEQ ID NO: 5060 - protein, 5 aa, Artificial Sequence
  Description of Artificial Sequence: Synthetic peptide
  XENP019766 vhCDR1
SNTMH

SEQ ID NO: 5061 - protein, 17 aa, Artificial Sequence
  Description of Artificial Sequence: Synthetic peptide
  XENP019766 vhCDR2
FISYDGNNKYYADSVKG

SEQ ID NO: 5062 - protein, 9 aa, Artificial Sequence
  Description of Artificial Sequence: Synthetic peptide
  XENP019766 vhCDR3
TGWLGPFDY

SEQ ID NO: 5063 - protein, 12 aa, Artificial Sequence
  Description of Artificial Sequence: Synthetic peptide
  XENP019766 vlCDR1
RASQSVGSSYLA

SEQ ID NO: 5064 - protein, 7 aa, Artificial Sequence
  Description of Artificial Sequence: Synthetic peptide
  XENP019766 vlCDR2
GAFSRAT

SEQ ID NO: 5065 - protein, 9 aa, Artificial Sequence
  Description of Artificial Sequence: Synthetic peptide
  XENP019766 vlCDR3
QQYGSSPWT

SEQ ID NO: 5066 - protein, 246 aa, Artificial Sequence
  Description of Artificial Sequence: Synthetic polypeptide
  XENP019767 [CTLA-4]_H0.23_L0_scFv(GKPGS)4
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5067 - protein, 118 aa, Artificial Sequence
  Description of Artificial Sequence: Synthetic polypeptide
  VH of XENP019767
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5068 - protein, 108 aa, Artificial Sequence; identical to SEQ ID NO: 3741
  Description of Artificial Sequence: Synthetic polypeptide
  VL of XENP019767

SEQ ID NO: 5069 - protein, 5 aa, Artificial Sequence
  Description of Artificial Sequence: Synthetic peptide
  XENP019767 vhCDR1
SSTMH

SEQ ID NO: 5070 - protein, 17 aa, Artificial Sequence
  Description of Artificial Sequence: Synthetic peptide
  XENP019767 vhCDR2
FISYDGNNKYYADSVKG

SEQ ID NO: 5071 - protein, 9 aa, Artificial Sequence
  Description of Artificial Sequence: Synthetic peptide
  XENP019767 vhCDR3
TGWLGPFDY

SEQ ID NO: 5072 - protein, 12 aa, Artificial Sequence
  Description of Artificial Sequence: Synthetic peptide
  XENP019767 vlCDR1
RASQSVGSSYLA

SEQ ID NO: 5073 - protein, 7 aa, Artificial Sequence
  Description of Artificial Sequence: Synthetic peptide
  XENP019767 vlCDR2
GAFSRAT

SEQ ID NO: 5074 - protein, 9 aa, Artificial Sequence
  Description of Artificial Sequence: Synthetic peptide
  XENP019767 vlCDR3
QQYGSSPWT

SEQ ID NO: 5075 - protein, 246 aa, Artificial Sequence
  Description of Artificial Sequence: Synthetic polypeptide
  XENP019768 [CTLA-4]_H0.24_L0_scFv(GKPGS)4
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5076 - protein, 118 aa, Artificial Sequence
  Description of Artificial Sequence: Synthetic polypeptide
  VH of XENP019768
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5077 - protein, 108 aa, Artificial Sequence; identical to SEQ ID NO: 3741
  Description of Artificial Sequence: Synthetic polypeptide
  VL of XENP019768

SEQ ID NO: 5078 - protein, 5 aa, Artificial Sequence
  Description of Artificial Sequence: Synthetic peptide
  XENP019768 vhCDR1
SVTMH

SEQ ID NO: 5079 - protein, 17 aa, Artificial Sequence
  Description of Artificial Sequence: Synthetic peptide
  XENP019768 vhCDR2
FISYDGNNKYYADSVKG

SEQ ID NO: 5080 - protein, 9 aa, Artificial Sequence
  Description of Artificial Sequence: Synthetic peptide
  XENP019768 vhCDR3
TGWLGPFDY

SEQ ID NO: 5081 - protein, 12 aa, Artificial Sequence
  Description of Artificial Sequence: Synthetic peptide
  XENP019768 vlCDR1
RASQSVGSSYLA

SEQ ID NO: 5082 - protein, 7 aa, Artificial Sequence
  Description of Artificial Sequence: Synthetic peptide
  XENP019768 vlCDR2
GAFSRAT

SEQ ID NO: 5083 - protein, 9 aa, Artificial Sequence
  Description of Artificial Sequence: Synthetic peptide
  XENP019768 vlCDR3
QQYGSSPWT

SEQ ID NO: 5084 - protein, 246 aa, Artificial Sequence
  Description of Artificial Sequence: Synthetic polypeptide
  XENP019769 [CTLA-4]_H0.25_L0_scFv(GKPGS)4
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5085 - protein, 118 aa, Artificial Sequence
  Description of Artificial Sequence: Synthetic polypeptide
  VH of XENP019769
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5086 - protein, 108 aa, Artificial Sequence; identical to SEQ ID NO: 3741
  Description of Artificial Sequence: Synthetic polypeptide
  VL of XENP019769

SEQ ID NO: 5087 - protein, 5 aa, Artificial Sequence
  Description of Artificial Sequence: Synthetic peptide
  XENP019769 vhCDR1
SYAMH

SEQ ID NO: 5088 - protein, 17 aa, Artificial Sequence
  Description of Artificial Sequence: Synthetic peptide
  XENP019769 vhCDR2
FISYDGNNKYYADSVKG

SEQ ID NO: 5089 - protein, 9 aa, Artificial Sequence
  Description of Artificial Sequence: Synthetic peptide
  XENP019769 vhCDR3
TGWLGPFDY

SEQ ID NO: 5090 - protein, 12 aa, Artificial Sequence
  Description of Artificial Sequence: Synthetic peptide
  XENP019769 vlCDR1
RASQSVGSSYLA

SEQ ID NO: 5091 - protein, 7 aa, Artificial Sequence
  Description of Artificial Sequence: Synthetic peptide
  XENP019769 vlCDR2
GAFSRAT

SEQ ID NO: 5092 - protein, 9 aa, Artificial Sequence
  Description of Artificial Sequence: Synthetic peptide
  XENP019769 vlCDR3
QQYGSSPWT

SEQ ID NO: 5093 - protein, 246 aa, Artificial Sequence
  Description of Artificial Sequence: Synthetic polypeptide
  XENP019770 [CTLA-4]_H0.26_L0_scFv(GKPGS)4
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5094 - protein, 118 aa, Artificial Sequence
  Description of Artificial Sequence: Synthetic polypeptide
  VH of XENP019770
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5095 - protein, 108 aa, Artificial Sequence; identical to SEQ ID NO: 3741
  Description of Artificial Sequence: Synthetic polypeptide
  VL of XENP019770

SEQ ID NO: 5096 - protein, 5 aa, Artificial Sequence
  Description of Artificial Sequence: Synthetic peptide
  XENP019770 vhCDR1
SYGMH

SEQ ID NO: 5097 - protein, 17 aa, Artificial Sequence
  Description of Artificial Sequence: Synthetic peptide
  XENP019770 vhCDR2
FISYDGNNKYYADSVKG

SEQ ID NO: 5098 - protein, 9 aa, Artificial Sequence
  Description of Artificial Sequence: Synthetic peptide
  XENP019770 vhCDR3
TGWLGPFDY

SEQ ID NO: 5099 - protein, 12 aa, Artificial Sequence
  Description of Artificial Sequence: Synthetic peptide
  XENP019770 vlCDR1
RASQSVGSSYLA

SEQ ID NO: 5100 - protein, 7 aa, Artificial Sequence
  Description of Artificial Sequence: Synthetic peptide
  XENP019770 vlCDR2
GAFSRAT

SEQ ID NO: 5101 - protein, 9 aa, Artificial Sequence
  Description of Artificial Sequence: Synthetic peptide
  XENP019770 vlCDR3
QQYGSSPWT

SEQ ID NO: 5102 - protein, 246 aa, Artificial Sequence
  Description of Artificial Sequence: Synthetic polypeptide
  XENP019771 [CTLA-4]_H0.27_L0_scFv(GKPGS)4
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5103 - protein, 118 aa, Artificial Sequence
  Description of Artificial Sequence: Synthetic polypeptide
  VH of XENP019771
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5104 - protein, 108 aa, Artificial Sequence; identical to SEQ ID NO: 3741
  Description of Artificial Sequence: Synthetic polypeptide
  VL of XENP019771

SEQ ID NO: 5105 - protein, 5 aa, Artificial Sequence
  Description of Artificial Sequence: Synthetic peptide
  XENP019771 vhCDR1
SYSMH

SEQ ID NO: 5106 - protein, 17 aa, Artificial Sequence
  Description of Artificial Sequence: Synthetic peptide
  XENP019771 vhCDR2
FISYDGNNKYYADSVKG

SEQ ID NO: 5107 - protein, 9 aa, Artificial Sequence
  Description of Artificial Sequence: Synthetic peptide
  XENP019771 vhCDR3
TGWLGPFDY

SEQ ID NO: 5108 - protein, 12 aa, Artificial Sequence
  Description of Artificial Sequence: Synthetic peptide
  XENP019771 vlCDR1
RASQSVGSSYLA

SEQ ID NO: 5109 - protein, 7 aa, Artificial Sequence
  Description of Artificial Sequence: Synthetic peptide
  XENP019771 vlCDR2
GAFSRAT

SEQ ID NO: 5110 - protein, 9 aa, Artificial Sequence
  Description of Artificial Sequence: Synthetic peptide
  XENP019771 vlCDR3
QQYGSSPWT

SEQ ID NO: 5111 - protein, 246 aa, Artificial Sequence
  Description of Artificial Sequence: Synthetic polypeptide
  XENP019772 [CTLA-4]_H0.28_L0_scFv(GKPGS)4
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5112 - protein, 118 aa, Artificial Sequence
  Description of Artificial Sequence: Synthetic polypeptide
  VH of XENP019772
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5113 - protein, 108 aa, Artificial Sequence; identical to SEQ ID NO: 3741
  Description of Artificial Sequence: Synthetic polypeptide
  VL of XENP019772

SEQ ID NO: 5114 - protein, 5 aa, Artificial Sequence
  Description of Artificial Sequence: Synthetic peptide
  XENP019772 vhCDR1
SYVMH

SEQ ID NO: 5115 - protein, 17 aa, Artificial Sequence
  Description of Artificial Sequence: Synthetic peptide
  XENP019772 vhCDR2
FISYDGNNKYYADSVKG

SEQ ID NO: 5116 - protein, 9 aa, Artificial Sequence
  Description of Artificial Sequence: Synthetic peptide
  XENP019772 vhCDR3
TGWLGPFDY

SEQ ID NO: 5117 - protein, 12 aa, Artificial Sequence
  Description of Artificial Sequence: Synthetic peptide
  XENP019772 vlCDR1
RASQSVGSSYLA

SEQ ID NO: 5118 - protein, 7 aa, Artificial Sequence
  Description of Artificial Sequence: Synthetic peptide
  XENP019772 vlCDR2
GAFSRAT

SEQ ID NO: 5119 - protein, 9 aa, Artificial Sequence
  Description of Artificial Sequence: Synthetic peptide
  XENP019772 vlCDR3
QQYGSSPWT

SEQ ID NO: 5120 - protein, 246 aa, Artificial Sequence
  Description of Artificial Sequence: Synthetic polypeptide
  XENP019773 [CTLA-4]_H0.29_L0_scFv(GKPGS)4
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5121 - protein, 118 aa, Artificial Sequence
  Description of Artificial Sequence: Synthetic polypeptide
  VH of XENP019773
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5122 - protein, 108 aa, Artificial Sequence; identical to SEQ ID NO: 3741
  Description of Artificial Sequence: Synthetic polypeptide
  VL of XENP019773

SEQ ID NO: 5123 - protein, 5 aa, Artificial Sequence
  Description of Artificial Sequence: Synthetic peptide
  XENP019773 vhCDR1
SYYMH

SEQ ID NO: 5124 - protein, 17 aa, Artificial Sequence
  Description of Artificial Sequence: Synthetic peptide
  XENP019773 vhCDR2
FISYDGNNKYYADSVKG

SEQ ID NO: 5125 - protein, 9 aa, Artificial Sequence
  Description of Artificial Sequence: Synthetic peptide
  XENP019773 vhCDR3
TGWLGPFDY

SEQ ID NO: 5126 - protein, 12 aa, Artificial Sequence
  Description of Artificial Sequence: Synthetic peptide
  XENP019773 vlCDR1
RASQSVGSSYLA

SEQ ID NO: 5127 - protein, 7 aa, Artificial Sequence
  Description of Artificial Sequence: Synthetic peptide
  XENP019773 vlCDR2
GAFSRAT

SEQ ID NO: 5128 - protein, 9 aa, Artificial Sequence
  Description of Artificial Sequence: Synthetic peptide
  XENP019773 vlCDR3
QQYGSSPWT

SEQ ID NO: 5129 - protein, 246 aa, Artificial Sequence
  Description of Artificial Sequence: Synthetic polypeptide
  XENP019774 [CTLA-4]_H0.30_L0_scFv(GKPGS)4
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5130 - protein, 118 aa, Artificial Sequence
  Description of Artificial Sequence: Synthetic polypeptide
  VH of XENP019774
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5131 - protein, 108 aa, Artificial Sequence; identical to SEQ ID NO: 3741
  Description of Artificial Sequence: Synthetic polypeptide
  VL of XENP019774

SEQ ID NO: 5132 - protein, 5 aa, Artificial Sequence
  Description of Artificial Sequence: Synthetic peptide
  XENP019774 vhCDR1
SYTMD

SEQ ID NO: 5133 - protein, 17 aa, Artificial Sequence
  Description of Artificial Sequence: Synthetic peptide
  XENP019774 vhCDR2
FISYDGNNKYYADSVKG

SEQ ID NO: 5134 - protein, 9 aa, Artificial Sequence
  Description of Artificial Sequence: Synthetic peptide
  XENP019774 vhCDR3
TGWLGPFDY

SEQ ID NO: 5135 - protein, 12 aa, Artificial Sequence
  Description of Artificial Sequence: Synthetic peptide
  XENP019774 vlCDR1
RASQSVGSSYLA

SEQ ID NO: 5136 - protein, 7 aa, Artificial Sequence
  Description of Artificial Sequence: Synthetic peptide
  XENP019774 vlCDR2
GAFSRAT

SEQ ID NO: 5137 - protein, 9 aa, Artificial Sequence
  Description of Artificial Sequence: Synthetic peptide
  XENP019774 vlCDR3
QQYGSSPWT

SEQ ID NO: 5138 - protein, 246 aa, Artificial Sequence
  Description of Artificial Sequence: Synthetic polypeptide
  XENP019775 [CTLA-4]_H0.31_L0_scFv(GKPGS)4
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5139 - protein, 118 aa, Artificial Sequence
  Description of Artificial Sequence: Synthetic polypeptide
  VH of XENP019775
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5140 - protein, 108 aa, Artificial Sequence; identical to SEQ ID NO: 3741
  Description of Artificial Sequence: Synthetic polypeptide
  VL of XENP019775

SEQ ID NO: 5141 - protein, 5 aa, Artificial Sequence
  Description of Artificial Sequence: Synthetic peptide
  XENP019775 vhCDR1
SYTMF

SEQ ID NO: 5142 - protein, 17 aa, Artificial Sequence
  Description of Artificial Sequence: Synthetic peptide
  XENP019775 vhCDR2
FISYDGNNKYYADSVKG

SEQ ID NO: 5143 - protein, 9 aa, Artificial Sequence
  Description of Artificial Sequence: Synthetic peptide
  XENP019775 vhCDR3
TGWLGPFDY

SEQ ID NO: 5144 - protein, 12 aa, Artificial Sequence
  Description of Artificial Sequence: Synthetic peptide
  XENP019775 vlCDR1
RASQSVGSSYLA

SEQ ID NO: 5145 - protein, 7 aa, Artificial Sequence
  Description of Artificial Sequence: Synthetic peptide
  XENP019775 vlCDR2
GAFSRAT

SEQ ID NO: 5146 - protein, 9 aa, Artificial Sequence
  Description of Artificial Sequence: Synthetic peptide
  XENP019775 vlCDR3
QQYGSSPWT

SEQ ID NO: 5147 - protein, 246 aa, Artificial Sequence
  Description of Artificial Sequence: Synthetic polypeptide
  XENP019776 [CTLA-4]_H0.32_L0_scFv(GKPGS)4
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5148 - protein, 118 aa, Artificial Sequence
  Description of Artificial Sequence: Synthetic polypeptide
  VH of XENP019776
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5149 - protein, 108 aa, Artificial Sequence; identical to SEQ ID NO: 3741
  Description of Artificial Sequence: Synthetic polypeptide
  VL of XENP019776

SEQ ID NO: 5150 - protein, 5 aa, Artificial Sequence
  Description of Artificial Sequence: Synthetic peptide
  XENP019776 vhCDR1
SYTMN

SEQ ID NO: 5151 - protein, 17 aa, Artificial Sequence
  Description of Artificial Sequence: Synthetic peptide
  XENP019776 vhCDR2
FISYDGNNKYYADSVKG

SEQ ID NO: 5152 - protein, 9 aa, Artificial Sequence
  Description of Artificial Sequence: Synthetic peptide
  XENP019776 vhCDR3
TGWLGPFDY

SEQ ID NO: 5153 - protein, 12 aa, Artificial Sequence
  Description of Artificial Sequence: Synthetic peptide
  XENP019776 vlCDR1
RASQSVGSSYLA

SEQ ID NO: 5154 - protein, 7 aa, Artificial Sequence
  Description of Artificial Sequence: Synthetic peptide
  XENP019776 vlCDR2
GAFSRAT

SEQ ID NO: 5155 - protein, 9 aa, Artificial Sequence
  Description of Artificial Sequence: Synthetic peptide
  XENP019776 vlCDR3
QQYGSSPWT

SEQ ID NO: 5156 - protein, 246 aa, Artificial Sequence
  Description of Artificial Sequence: Synthetic polypeptide
  XENP019777 [CTLA-4]_H0.33_L0_scFv(GKPGS)4
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5157 - protein, 118 aa, Artificial Sequence
  Description of Artificial Sequence: Synthetic polypeptide
  VH of XENP019777
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5158 - protein, 108 aa, Artificial Sequence; identical to SEQ ID NO: 3741
  Description of Artificial Sequence: Synthetic polypeptide
  VL of XENP019777

SEQ ID NO: 5159 - protein, 5 aa, Artificial Sequence
  Description of Artificial Sequence: Synthetic peptide
  XENP019777 vhCDR1
SYTMS

SEQ ID NO: 5160 - protein, 17 aa, Artificial Sequence
  Description of Artificial Sequence: Synthetic peptide
  XENP019777 vhCDR2
FISYDGNNKYYADSVKG

SEQ ID NO: 5161 - protein, 9 aa, Artificial Sequence
  Description of Artificial Sequence: Synthetic peptide
  XENP019777 vhCDR3
TGWLGPFDY

SEQ ID NO: 5162 - protein, 12 aa, Artificial Sequence
  Description of Artificial Sequence: Synthetic peptide
  XENP019777 vlCDR1
RASQSVGSSYLA

SEQ ID NO: 5163 - protein, 7 aa, Artificial Sequence
  Description of Artificial Sequence: Synthetic peptide
  XENP019777 vlCDR2
GAFSRAT

SEQ ID NO: 5164 - protein, 9 aa, Artificial Sequence
  Description of Artificial Sequence: Synthetic peptide
  XENP019777 vlCDR3
QQYGSSPWT

SEQ ID NO: 5165 - protein, 246 aa, Artificial Sequence
  Description of Artificial Sequence: Synthetic polypeptide
  XENP019778 [CTLA-4]_H0.34_L0_scFv(GKPGS)4
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5166 - protein, 118 aa, Artificial Sequence
  Description of Artificial Sequence: Synthetic polypeptide
  VH of XENP019778
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5167 - protein, 108 aa, Artificial Sequence; identical to SEQ ID NO: 3741
  Description of Artificial Sequence: Synthetic polypeptide
  VL of XENP019778

SEQ ID NO: 5168 - protein, 5 aa, Artificial Sequence
  Description of Artificial Sequence: Synthetic peptide
  XENP019778 vhCDR1
SYTMY

SEQ ID NO: 5169 - protein, 17 aa, Artificial Sequence
  Description of Artificial Sequence: Synthetic peptide
  XENP019778 vhCDR2
FISYDGNNKYYADSVKG

SEQ ID NO: 5170 - protein, 9 aa, Artificial Sequence
  Description of Artificial Sequence: Synthetic peptide
  XENP019778 vhCDR3
TGWLGPFDY

SEQ ID NO: 5171 - protein, 12 aa, Artificial Sequence
  Description of Artificial Sequence: Synthetic peptide
  XENP019778 vlCDR1
RASQSVGSSYLA

SEQ ID NO: 5172 - protein, 7 aa, Artificial Sequence
  Description of Artificial Sequence: Synthetic peptide
  XENP019778 vlCDR2
GAFSRAT

SEQ ID NO: 5173 - protein, 9 aa, Artificial Sequence
  Description of Artificial Sequence: Synthetic peptide
  XENP019778 vlCDR3
QQYGSSPWT

SEQ ID NO: 5174 - protein, 246 aa, Artificial Sequence
  Description of Artificial Sequence: Synthetic polypeptide
  XENP019779 [CTLA-4]_H0.35_L0_scFv(GKPGS)4
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5175 - protein, 118 aa, Artificial Sequence
  Description of Artificial Sequence: Synthetic polypeptide
  VH of XENP019779
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSS

SEQ ID NO: 5176 - protein, 108 aa, Artificial Sequence; identical to SEQ ID NO: 3741
  Description of Artificial Sequence: Synthetic polypeptide
  VL of XENP019779

SEQ ID NO: 5177 - protein, 5 aa, Artificial Sequence
  Description of Artificial Sequence: Synthetic peptide
  XENP019779 vhCDR1
SYTMH

SEQ ID NO: 5178 - protein, 17 aa, Artificial Sequence
  Description of Artificial Sequence: Synthetic peptide
  XENP019779 vhCDR2
FISYDGNNKYYADSVKG

SEQ ID NO: 5179 - protein, 9 aa, Artificial Sequence
  Description of Artificial Sequence: Synthetic peptide
  XENP019779 vhCDR3
TGWLGPFDY

SEQ ID NO: 5180 - protein, 12 aa, Artificial Sequence
  Description of Artificial Sequence: Synthetic peptide
  XENP019779 vlCDR1
RASQSVGSSYLA

SEQ ID NO: 5181 - protein, 7 aa, Artificial Sequence
  Description of Artificial Sequence: Synthetic peptide
  XENP019779 vlCDR2
GAFSRAT

SEQ ID NO: 5182 - protein, 9 aa, Artificial Sequence
  Description of Artificial Sequence: Synthetic peptide
  XENP019779 vlCDR3
QQYGSSPWT

SEQ ID NO: 5183 - protein, 246 aa, Artificial Sequence
  Description of Artificial Sequence: Synthetic polypeptide
  XENP019780 [CTLA-4]_H0.36_L0_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5184 - protein, 118 aa, Artificial Sequence; identical to SEQ ID NO: 4707
  Description of Artificial Sequence: Synthetic polypeptide
  VH of XENP019780

SEQ ID NO: 5185 - protein, 108 aa, Artificial Sequence; identical to SEQ ID NO: 3741
  Description of Artificial Sequence: Synthetic polypeptide
  VL of XENP019780

SEQ ID NO: 5186 - protein, 5 aa, Artificial Sequence
  Description of Artificial Sequence: Synthetic peptide
  XENP019780 vhCDR1
SYTMH

SEQ ID NO: 5187 - protein, 17 aa, Artificial Sequence
  Description of Artificial Sequence: Synthetic peptide
  XENP019780 vhCDR2
FISYDGNNKYYADSVKG

SEQ ID NO: 5188 - protein, 9 aa, Artificial Sequence
  Description of Artificial Sequence: Synthetic peptide
  XENP019780 vhCDR3
TGWLGPFDY

SEQ ID NO: 5189 - protein, 12 aa, Artificial Sequence
  Description of Artificial Sequence: Synthetic peptide
  XENP019780 vlCDR1
RASQSVGSSYLA

SEQ ID NO: 5190 - protein, 7 aa, Artificial Sequence
  Description of Artificial Sequence: Synthetic peptide
  XENP019780 vlCDR2
GAFSRAT

SEQ ID NO: 5191 - protein, 9 aa, Artificial Sequence
  Description of Artificial Sequence: Synthetic peptide
  XENP019780 vlCDR3
QQYGSSPWT

SEQ ID NO: 5192 - protein, 246 aa, Artificial Sequence
  Description of Artificial Sequence: Synthetic polypeptide
  XENP019781 [CTLA-4]_H0.37_L0_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5193 - protein, 118 aa, Artificial Sequence; identical to SEQ ID NO: 4725
  Description of Artificial Sequence: Synthetic polypeptide
  VH of XENP019781

SEQ ID NO: 5194 - protein, 108 aa, Artificial Sequence; identical to SEQ ID NO: 3741
  Description of Artificial Sequence: Synthetic polypeptide
  VL of XENP019781

SEQ ID NO: 5195 - protein, 5 aa, Artificial Sequence
  Description of Artificial Sequence: Synthetic peptide
  XENP019781 vhCDR1
SYTMH

SEQ ID NO: 5196 - protein, 17 aa, Artificial Sequence
  Description of Artificial Sequence: Synthetic peptide
  XENP019781 vhCDR2
FISYDGNNKYYADSVKG

SEQ ID NO: 5197 - protein, 9 aa, Artificial Sequence
  Description of Artificial Sequence: Synthetic peptide
  XENP019781 vhCDR3
TGWLGPFDY

SEQ ID NO: 5198 - protein, 12 aa, Artificial Sequence
  Description of Artificial Sequence: Synthetic peptide
  XENP019781 vlCDR1
RASQSVGSSYLA

SEQ ID NO: 5199 - protein, 7 aa, Artificial Sequence
  Description of Artificial Sequence: Synthetic peptide
  XENP019781 vlCDR2
GAFSRAT

SEQ ID NO: 5200 - protein, 9 aa, Artificial Sequence
  Description of Artificial Sequence: Synthetic peptide
  XENP019781 vlCDR3
QQYGSSPWT

SEQ ID NO: 5201 - protein, 246 aa, Artificial Sequence
  Description of Artificial Sequence: Synthetic polypeptide
  XENP019782 [CTLA-4]_H0.38_L0_scFv(GKPGS)4
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5202 - protein, 118 aa, Artificial Sequence
  Description of Artificial Sequence: Synthetic polypeptide
  VH of XENP019782
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSS

SEQ ID NO: 5203 - protein, 108 aa, Artificial Sequence; identical to SEQ ID NO: 3741
  Description of Artificial Sequence: Synthetic polypeptide
  VL of XENP019782

SEQ ID NO: 5204 - protein, 5 aa, Artificial Sequence
  Description of Artificial Sequence: Synthetic peptide
  XENP019782 vhCDR1
SYTMH

SEQ ID NO: 5205 - protein, 17 aa, Artificial Sequence
  Description of Artificial Sequence: Synthetic peptide
  XENP019782 vhCDR2
FISYDGNNKYYADSVKG

SEQ ID NO: 5206 - protein, 9 aa, Artificial Sequence
  Description of Artificial Sequence: Synthetic peptide
  XENP019782 vhCDR3
TGWLGPFDY

SEQ ID NO: 5207 - protein, 12 aa, Artificial Sequence
  Description of Artificial Sequence: Synthetic peptide
  XENP019782 vlCDR1
RASQSVGSSYLA

SEQ ID NO: 5208 - protein, 7 aa, Artificial Sequence
  Description of Artificial Sequence: Synthetic peptide
  XENP019782 vlCDR2
GAFSRAT

SEQ ID NO: 5209 - protein, 9 aa, Artificial Sequence
  Description of Artificial Sequence: Synthetic peptide
  XENP019782 vlCDR3
QQYGSSPWT

SEQ ID NO: 5210 - protein, 246 aa, Artificial Sequence
  Description of Artificial Sequence: Synthetic polypeptide
  XENP019783 [CTLA-4]_H0.39_L0_scFv(GKPGS)4
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5211 - protein, 118 aa, Artificial Sequence
  Description of Artificial Sequence: Synthetic polypeptide
  VH of XENP019783
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSS

SEQ ID NO: 5212 - protein, 108 aa, Artificial Sequence; identical to SEQ ID NO: 3741
  Description of Artificial Sequence: Synthetic polypeptide
  VL of XENP019783

SEQ ID NO: 5213 - protein, 5 aa, Artificial Sequence
  Description of Artificial Sequence: Synthetic peptide
  XENP019783 vhCDR1
SYTMH

SEQ ID NO: 5214 - protein, 17 aa, Artificial Sequence
  Description of Artificial Sequence: Synthetic peptide
  XENP019783 vhCDR2
FISYDGNNKYYADSVKG

SEQ ID NO: 5215 - protein, 9 aa, Artificial Sequence
  Description of Artificial Sequence: Synthetic peptide
  XENP019783 vhCDR3
TGWLGPFDY

SEQ ID NO: 5216 - protein, 12 aa, Artificial Sequence
  Description of Artificial Sequence: Synthetic peptide
  XENP019783 vlCDR1
RASQSVGSSYLA

SEQ ID NO: 5217 - protein, 7 aa, Artificial Sequence
  Description of Artificial Sequence: Synthetic peptide
  XENP019783 vlCDR2
GAFSRAT

SEQ ID NO: 5218 - protein, 9 aa, Artificial Sequence
  Description of Artificial Sequence: Synthetic peptide
  XENP019783 vlCDR3
QQYGSSPWT

SEQ ID NO: 5219 - protein, 246 aa, Artificial Sequence
  Description of Artificial Sequence: Synthetic polypeptide
  XENP019784 [CTLA-4]_H0.40_L0_scFv(GKPGS)4
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5220 - protein, 118 aa, Artificial Sequence
  Description of Artificial Sequence: Synthetic polypeptide
  VH of XENP019784
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSS

SEQ ID NO: 5221 - protein, 108 aa, Artificial Sequence; identical to SEQ ID NO: 3741
  Description of Artificial Sequence: Synthetic polypeptide
  VL of XENP019784

SEQ ID NO: 5222 - protein, 5 aa, Artificial Sequence
  Description of Artificial Sequence: Synthetic peptide
  XENP019784 vhCDR1
SYTMH

SEQ ID NO: 5223 - protein, 17 aa, Artificial Sequence
  Description of Artificial Sequence: Synthetic peptide
  XENP019784 vhCDR2
FISYDGNNKYYADSVKG

SEQ ID NO: 5224 - protein, 9 aa, Artificial Sequence
  Description of Artificial Sequence: Synthetic peptide
  XENP019784 vhCDR3
TGWLGPFDY

SEQ ID NO: 5225 - protein, 12 aa, Artificial Sequence
  Description of Artificial Sequence: Synthetic peptide
  XENP019784 vlCDR1
RASQSVGSSYLA

SEQ ID NO: 5226 - protein, 7 aa, Artificial Sequence
  Description of Artificial Sequence: Synthetic peptide
  XENP019784 vlCDR2
GAFSRAT

SEQ ID NO: 5227 - protein, 9 aa, Artificial Sequence
  Description of Artificial Sequence: Synthetic peptide
  XENP019784 vlCDR3
QQYGSSPWT

SEQ ID NO: 5228 - protein, 246 aa, Artificial Sequence
  Description of Artificial Sequence: Synthetic polypeptide
  XENP019785 [CTLA-4]_H0.41_L0_scFv(GKPGS)4
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5229 - protein, 118 aa, Artificial Sequence
  Description of Artificial Sequence: Synthetic polypeptide
  VH of XENP019785
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSS

SEQ ID NO: 5230 - protein, 108 aa, Artificial Sequence; identical to SEQ ID NO: 3741
  Description of Artificial Sequence: Synthetic polypeptide
  VL of XENP019785

SEQ ID NO: 5231 - protein, 5 aa, Artificial Sequence
  Description of Artificial Sequence: Synthetic peptide
  XENP019785 vhCDR1
SYTMH

SEQ ID NO: 5232 - protein, 17 aa, Artificial Sequence
  Description of Artificial Sequence: Synthetic peptide
  XENP019785 vhCDR2
FISYDGNNKYYADSVKG

SEQ ID NO: 5233 - protein, 9 aa, Artificial Sequence
  Description of Artificial Sequence: Synthetic peptide
  XENP019785 vhCDR3
TGWLGPFDY

SEQ ID NO: 5234 - protein, 12 aa, Artificial Sequence
  Description of Artificial Sequence: Synthetic peptide
  XENP019785 vlCDR1
RASQSVGSSYLA

SEQ ID NO: 5235 - protein, 7 aa, Artificial Sequence
  Description of Artificial Sequence: Synthetic peptide
  XENP019785 vlCDR2
GAFSRAT

SEQ ID NO: 5236 - protein, 9 aa, Artificial Sequence
  Description of Artificial Sequence: Synthetic peptide
  XENP019785 vlCDR3
QQYGSSPWT

SEQ ID NO: 5237 - protein, 246 aa, Artificial Sequence
  Description of Artificial Sequence: Synthetic polypeptide
  XENP019786 [CTLA-4]_H0.42_L0_scFv(GKPGS)4
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5238 - protein, 118 aa, Artificial Sequence
  Description of Artificial Sequence: Synthetic polypeptide
  VH of XENP019786
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSS

SEQ ID NO: 5239 - protein, 108 aa, Artificial Sequence; identical to SEQ ID NO: 3741
  Description of Artificial Sequence: Synthetic polypeptide
  VL of XENP019786

SEQ ID NO: 5240 - protein, 5 aa, Artificial Sequence
  Description of Artificial Sequence: Synthetic peptide
  XENP019786 vhCDR1
SYTMH

SEQ ID NO: 5241 - protein, 17 aa, Artificial Sequence
  Description of Artificial Sequence: Synthetic peptide
  XENP019786 vhCDR2
AISYDGNNKYYADSVKG

SEQ ID NO: 5242 - protein, 9 aa, Artificial Sequence
  Description of Artificial Sequence: Synthetic peptide
  XENP019786 vhCDR3
TGWLGPFDY

SEQ ID NO: 5243 - protein, 12 aa, Artificial Sequence
  Description of Artificial Sequence: Synthetic peptide
  XENP019786 vlCDR1
RASQSVGSSYLA

SEQ ID NO: 5244 - protein, 7 aa, Artificial Sequence
  Description of Artificial Sequence: Synthetic peptide
  XENP019786 vlCDR2
GAFSRAT

SEQ ID NO: 5245 - protein, 9 aa, Artificial Sequence
  Description of Artificial Sequence: Synthetic peptide
  XENP019786 vlCDR3
QQYGSSPWT

SEQ ID NO: 5246 - protein, 246 aa, Artificial Sequence
  Description of Artificial Sequence: Synthetic polypeptide
  XENP019787 [CTLA-4]_H0.43_L0_scFv(GKPGS)4
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5247 - protein, 118 aa, Artificial Sequence
  Description of Artificial Sequence: Synthetic polypeptide
  VH of XENP019787
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSS

SEQ ID NO: 5248 - protein, 108 aa, Artificial Sequence; identical to SEQ ID NO: 3741
  Description of Artificial Sequence: Synthetic polypeptide
  VL of XENP019787

SEQ ID NO: 5249 - protein, 5 aa, Artificial Sequence
  Description of Artificial Sequence: Synthetic peptide
  XENP019787 vhCDR1
SYTMH

SEQ ID NO: 5250 - protein, 17 aa, Artificial Sequence
  Description of Artificial Sequence: Synthetic peptide
  XENP019787 vhCDR2
GISYDGNNKYYADSVKG

SEQ ID NO: 5251 - protein, 9 aa, Artificial Sequence
  Description of Artificial Sequence: Synthetic peptide
  XENP019787 vhCDR3
TGWLGPFDY

SEQ ID NO: 5252 - protein, 12 aa, Artificial Sequence
  Description of Artificial Sequence: Synthetic peptide
  XENP019787 vlCDR1
RASQSVGSSYLA

SEQ ID NO: 5253 - protein, 7 aa, Artificial Sequence
  Description of Artificial Sequence: Synthetic peptide
  XENP019787 vlCDR2
GAFSRAT

SEQ ID NO: 5254 - protein, 9 aa, Artificial Sequence
  Description of Artificial Sequence: Synthetic peptide
  XENP019787 vlCDR3
QQYGSSPWT

SEQ ID NO: 5255 - protein, 246 aa, Artificial Sequence
  Description of Artificial Sequence: Synthetic polypeptide
  XENP019788 [CTLA-4]_H0.44_L0_scFv(GKPGS)4
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5256 - protein, 118 aa, Artificial Sequence
  Description of Artificial Sequence: Synthetic polypeptide
  VH of XENP019788
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSS

SEQ ID NO: 5257 - protein, 108 aa, Artificial Sequence; identical to SEQ ID NO: 3741
  Description of Artificial Sequence: Synthetic polypeptide
  VL of XENP019788

SEQ ID NO: 5258 - protein, 5 aa, Artificial Sequence
  Description of Artificial Sequence: Synthetic peptide
  XENP019788 vhCDR1
SYTMH

SEQ ID NO: 5259 - protein, 17 aa, Artificial Sequence
  Description of Artificial Sequence: Synthetic peptide
  XENP019788 vhCDR2
LISYDGNNKYYADSVKG

SEQ ID NO: 5260 - protein, 9 aa, Artificial Sequence
  Description of Artificial Sequence: Synthetic peptide
  XENP019788 vhCDR3
TGWLGPFDY

SEQ ID NO: 5261 - protein, 12 aa, Artificial Sequence
  Description of Artificial Sequence: Synthetic peptide
  XENP019788 vlCDR1
RASQSVGSSYLA

SEQ ID NO: 5262 - protein, 7 aa, Artificial Sequence
  Description of Artificial Sequence: Synthetic peptide
  XENP019788 vlCDR2
GAFSRAT

SEQ ID NO: 5263 - protein, 9 aa, Artificial Sequence
  Description of Artificial Sequence: Synthetic peptide
  XENP019788 vlCDR3
QQYGSSPWT

SEQ ID NO: 5264 - protein, 246 aa, Artificial Sequence
  Description of Artificial Sequence: Synthetic polypeptide
  XENP019789 [CTLA-4]_H0.45_L0_scFv(GKPGS)4
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5265 - protein, 118 aa, Artificial Sequence
  Description of Artificial Sequence: Synthetic polypeptide
  VH of XENP019789
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSS

SEQ ID NO: 5266 - protein, 108 aa, Artificial Sequence; identical to SEQ ID NO: 3741
  Description of Artificial Sequence: Synthetic polypeptide
  VL of XENP019789

SEQ ID NO: 5267 - protein, 5 aa, Artificial Sequence
  Description of Artificial Sequence: Synthetic peptide
  XENP019789 vhCDR1
SYTMH

SEQ ID NO: 5268 - protein, 17 aa, Artificial Sequence
  Description of Artificial Sequence: Synthetic peptide
  XENP019789 vhCDR2
IISYDGNNKYYADSVKG

SEQ ID NO: 5269 - protein, 9 aa, Artificial Sequence
  Description of Artificial Sequence: Synthetic peptide
  XENP019789 vhCDR3
TGWLGPFDY

SEQ ID NO: 5270 - protein, 12 aa, Artificial Sequence
  Description of Artificial Sequence: Synthetic peptide
  XENP019789 vlCDR1
RASQSVGSSYLA

SEQ ID NO: 5271 - protein, 7 aa, Artificial Sequence
  Description of Artificial Sequence: Synthetic peptide
  XENP019789 vlCDR2
GAFSRAT

SEQ ID NO: 5272 - protein, 9 aa, Artificial Sequence
  Description of Artificial Sequence: Synthetic peptide
  XENP019789 vlCDR3
QQYGSSPWT

SEQ ID NO: 5273 - protein, 246 aa, Artificial Sequence
  Description of Artificial Sequence: Synthetic polypeptide
  XENP019790 [CTLA-4]_H0.46_L0_scFv(GKPGS)4
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5274 - protein, 118 aa, Artificial Sequence
  Description of Artificial Sequence: Synthetic polypeptide
  VH of XENP019790
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSS

SEQ ID NO: 5275 - protein, 108 aa, Artificial Sequence; identical to SEQ ID NO: 3741
  Description of Artificial Sequence: Synthetic polypeptide
  VL of XENP019790

SEQ ID NO: 5276 - protein, 5 aa, Artificial Sequence
  Description of Artificial Sequence: Synthetic peptide
  XENP019790 vhCDR1
SYTMH

SEQ ID NO: 5277 - protein, 17 aa, Artificial Sequence
  Description of Artificial Sequence: Synthetic peptide
  XENP019790 vhCDR2
RISYDGNNKYYADSVKG

SEQ ID NO: 5278 - protein, 9 aa, Artificial Sequence
  Description of Artificial Sequence: Synthetic peptide
  XENP019790 vhCDR3
TGWLGPFDY

SEQ ID NO: 5279 - protein, 12 aa, Artificial Sequence
  Description of Artificial Sequence: Synthetic peptide
  XENP019790 vlCDR1
RASQSVGSSYLA

SEQ ID NO: 5280 - protein, 7 aa, Artificial Sequence
  Description of Artificial Sequence: Synthetic peptide
  XENP019790 vlCDR2
GAFSRAT

SEQ ID NO: 5281 - protein, 9 aa, Artificial Sequence
  Description of Artificial Sequence: Synthetic peptide
  XENP019790 vlCDR3
QQYGSSPWT

SEQ ID NO: 5282 - protein, 246 aa, Artificial Sequence
  Description of Artificial Sequence: Synthetic polypeptide
  XENP019791 [CTLA-4]_H0.47_L0_scFv(GKPGS)4
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5283 - protein, 118 aa, Artificial Sequence
  Description of Artificial Sequence: Synthetic polypeptide
  VH of XENP019791
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSS

SEQ ID NO: 5284 - protein, 108 aa, Artificial Sequence; identical to SEQ ID NO: 3741
  Description of Artificial Sequence: Synthetic polypeptide
  VL of XENP019791

SEQ ID NO: 5285 - protein, 5 aa, Artificial Sequence
  Description of Artificial Sequence: Synthetic peptide
  XENP019791 vhCDR1
SYTMH

SEQ ID NO: 5286 - protein, 17 aa, Artificial Sequence
  Description of Artificial Sequence: Synthetic peptide
  XENP019791 vhCDR2
VISYDGNNKYYADSVKG

SEQ ID NO: 5287 - protein, 9 aa, Artificial Sequence
  Description of Artificial Sequence: Synthetic peptide
  XENP019791 vhCDR3
TGWLGPFDY

SEQ ID NO: 5288 - protein, 12 aa, Artificial Sequence
  Description of Artificial Sequence: Synthetic peptide
  XENP019791 vlCDR1
RASQSVGSSYLA

SEQ ID NO: 5289 - protein, 7 aa, Artificial Sequence
  Description of Artificial Sequence: Synthetic peptide
  XENP019791 vlCDR2
GAFSRAT

SEQ ID NO: 5290 - protein, 9 aa, Artificial Sequence
  Description of Artificial Sequence: Synthetic peptide
  XENP019791 vlCDR3
QQYGSSPWT

SEQ ID NO: 5291 - protein, 246 aa, Artificial Sequence
  Description of Artificial Sequence: Synthetic polypeptide
  XENP019792 [CTLA-4]_H0.48_L0_scFv(GKPGS)4
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5292 - protein, 118 aa, Artificial Sequence
  Description of Artificial Sequence: Synthetic polypeptide
  VH of XENP019792
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSS

SEQ ID NO: 5293 - protein, 108 aa, Artificial Sequence; identical to SEQ ID NO: 3741
  Description of Artificial Sequence: Synthetic polypeptide
  VL of XENP019792

SEQ ID NO: 5294 - protein, 5 aa, Artificial Sequence
  Description of Artificial Sequence: Synthetic peptide
  XENP019792 vhCDR1
SYTMH

SEQ ID NO: 5295 - protein, 17 aa, Artificial Sequence
  Description of Artificial Sequence: Synthetic peptide
  XENP019792 vhCDR2
YISYDGNNKYYADSVKG

SEQ ID NO: 5296 - protein, 9 aa, Artificial Sequence
  Description of Artificial Sequence: Synthetic peptide
  XENP019792 vhCDR3
TGWLGPFDY

SEQ ID NO: 5297 - protein, 12 aa, Artificial Sequence
  Description of Artificial Sequence: Synthetic peptide
  XENP019792 vlCDR1
RASQSVGSSYLA

SEQ ID NO: 5298 - protein, 7 aa, Artificial Sequence
  Description of Artificial Sequence: Synthetic peptide
  XENP019792 vlCDR2
GAFSRAT

SEQ ID NO: 5299 - protein, 9 aa, Artificial Sequence
  Description of Artificial Sequence: Synthetic peptide
  XENP019792 vlCDR3
QQYGSSPWT

SEQ ID NO: 5300 - protein, 246 aa, Artificial Sequence
  Description of Artificial Sequence: Synthetic polypeptide
  XENP019793 [CTLA-4]_H0.49_L0_scFv(GKPGS)4
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5301 - protein, 118 aa, Artificial Sequence
  Description of Artificial Sequence: Synthetic polypeptide
  VH of XENP019793
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSS

SEQ ID NO: 5302 - protein, 108 aa, Artificial Sequence; identical to SEQ ID NO: 3741
  Description of Artificial Sequence: Synthetic polypeptide
  VL of XENP019793

SEQ ID NO: 5303 - protein, 5 aa, Artificial Sequence
  Description of Artificial Sequence: Synthetic peptide
  XENP019793 vhCDR1
SYTMH

SEQ ID NO: 5304 - protein, 17 aa, Artificial Sequence
  Description of Artificial Sequence: Synthetic peptide
  XENP019793 vhCDR2
FESYDGNNKYYADSVKG

SEQ ID NO: 5305 - protein, 9 aa, Artificial Sequence
  Description of Artificial Sequence: Synthetic peptide
  XENP019793 vhCDR3
TGWLGPFDY

SEQ ID NO: 5306 - protein, 12 aa, Artificial Sequence
  Description of Artificial Sequence: Synthetic peptide
  XENP019793 vlCDR1
RASQSVGSSYLA

SEQ ID NO: 5307 - protein, 7 aa, Artificial Sequence
  Description of Artificial Sequence: Synthetic peptide
  XENP019793 vlCDR2
GAFSRAT

SEQ ID NO: 5308 - protein, 9 aa, Artificial Sequence
  Description of Artificial Sequence: Synthetic peptide
  XENP019793 vlCDR3
QQYGSSPWT

SEQ ID NO: 5309 - protein, 246 aa, Artificial Sequence
  Description of Artificial Sequence: Synthetic polypeptide
  XENP019794 [CTLA-4]_H0.50_L0_scFv(GKPGS)4
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5310 - protein, 118 aa, Artificial Sequence
  Description of Artificial Sequence: Synthetic polypeptide
  VH of XENP019794
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSS

SEQ ID NO: 5311 - protein, 108 aa, Artificial Sequence; identical to SEQ ID NO: 3741
  Description of Artificial Sequence: Synthetic polypeptide
  VL of XENP019794

SEQ ID NO: 5312 - protein, 5 aa, Artificial Sequence
  Description of Artificial Sequence: Synthetic peptide
  XENP019794 vhCDR1
SYTMH

SEQ ID NO: 5313 - protein, 17 aa, Artificial Sequence
  Description of Artificial Sequence: Synthetic peptide
  XENP019794 vhCDR2
FHSYDGNNKYYADSVKG

SEQ ID NO: 5314 - protein, 9 aa, Artificial Sequence
  Description of Artificial Sequence: Synthetic peptide
  XENP019794 vhCDR3
TGWLGPFDY

SEQ ID NO: 5315 - protein, 12 aa, Artificial Sequence
  Description of Artificial Sequence: Synthetic peptide
  XENP019794 vlCDR1
RASQSVGSSYLA

SEQ ID NO: 5316 - protein, 7 aa, Artificial Sequence
  Description of Artificial Sequence: Synthetic peptide
  XENP019794 vlCDR2
GAFSRAT

SEQ ID NO: 5317 - protein, 9 aa, Artificial Sequence
  Description of Artificial Sequence: Synthetic peptide
  XENP019794 vlCDR3
QQYGSSPWT

SEQ ID NO: 5318 - protein, 246 aa, Artificial Sequence
  Description of Artificial Sequence: Synthetic polypeptide
  XENP019795 [CTLA-4]_H0.51_L0_scFv(GKPGS)4
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5319 - protein, 118 aa, Artificial Sequence
  Description of Artificial Sequence: Synthetic polypeptide
  VH of XENP019795
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSS

SEQ ID NO: 5320 - protein, 108 aa, Artificial Sequence; identical to SEQ ID NO: 3741
  Description of Artificial Sequence: Synthetic polypeptide
  VL of XENP019795

SEQ ID NO: 5321 - protein, 5 aa, Artificial Sequence
  Description of Artificial Sequence: Synthetic peptide
  XENP019795 vhCDR1
SYTMH

SEQ ID NO: 5322 - protein, 17 aa, Artificial Sequence
  Description of Artificial Sequence: Synthetic peptide
  XENP019795 vhCDR2
FTSYDGNNKYYADSVKG

SEQ ID NO: 5323 - protein, 9 aa, Artificial Sequence
  Description of Artificial Sequence: Synthetic peptide
  XENP019795 vhCDR3
TGWLGPFDY

SEQ ID NO: 5324 - protein, 12 aa, Artificial Sequence
  Description of Artificial Sequence: Synthetic peptide
  XENP019795 vlCDR1
RASQSVGSSYLA

SEQ ID NO: 5325 - protein, 7 aa, Artificial Sequence
  Description of Artificial Sequence: Synthetic peptide
  XENP019795 vlCDR2
GAFSRAT

SEQ ID NO: 5326 - protein, 9 aa, Artificial Sequence
  Description of Artificial Sequence: Synthetic peptide
  XENP019795 vlCDR3
QQYGSSPWT

SEQ ID NO: 5327 - protein, 246 aa, Artificial Sequence
  Description of Artificial Sequence: Synthetic polypeptide
  XENP019796 [CTLA-4]_H0.52_L0_scFv(GKPGS)4
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5328 - protein, 118 aa, Artificial Sequence
  Description of Artificial Sequence: Synthetic polypeptide
  VH of XENP019796
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSS

SEQ ID NO: 5329 - protein, 108 aa, Artificial Sequence; identical to SEQ ID NO: 3741
  Description of Artificial Sequence: Synthetic polypeptide
  VL of XENP019796

SEQ ID NO: 5330 - protein, 5 aa, Artificial Sequence
  Description of Artificial Sequence: Synthetic peptide
  XENP019796 vhCDR1
SYTMH

SEQ ID NO: 5331 - protein, 17 aa, Artificial Sequence
  Description of Artificial Sequence: Synthetic peptide
  XENP019796 vhCDR2
FVSYDGNNKYYADSVKG

SEQ ID NO: 5332 - protein, 9 aa, Artificial Sequence
  Description of Artificial Sequence: Synthetic peptide
  XENP019796 vhCDR3
TGWLGPFDY

SEQ ID NO: 5333 - protein, 12 aa, Artificial Sequence
  Description of Artificial Sequence: Synthetic peptide
  XENP019796 vlCDR1
RASQSVGSSYLA

SEQ ID NO: 5334 - protein, 7 aa, Artificial Sequence
  Description of Artificial Sequence: Synthetic peptide
  XENP019796 vlCDR2
GAFSRAT

SEQ ID NO: 5335 - protein, 9 aa, Artificial Sequence
  Description of Artificial Sequence: Synthetic peptide
  XENP019796 vlCDR3
QQYGSSPWT

SEQ ID NO: 5336 - protein, 246 aa, Artificial Sequence
  Description of Artificial Sequence: Synthetic polypeptide
  XENP019801 [CTLA-4]_H0.53_L0_scFv(GKPGS)4
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5337 - protein, 118 aa, Artificial Sequence
  Description of Artificial Sequence: Synthetic polypeptide
  VH of XENP019801
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSS

SEQ ID NO: 5338 - protein, 108 aa, Artificial Sequence; identical to SEQ ID NO: 3741
  Description of Artificial Sequence: Synthetic polypeptide
  VL of XENP019801

SEQ ID NO: 5339 - protein, 5 aa, Artificial Sequence
  Description of Artificial Sequence: Synthetic peptide
  XENP019801 vhCDR1
SYTMH

SEQ ID NO: 5340 - protein, 17 aa, Artificial Sequence
  Description of Artificial Sequence: Synthetic peptide
  XENP019801 vhCDR2
FYSYDGNNKYYADSVKG

SEQ ID NO: 5341 - protein, 9 aa, Artificial Sequence
  Description of Artificial Sequence: Synthetic peptide
  XENP019801 vhCDR3
TGWLGPFDY

SEQ ID NO: 5342 - protein, 12 aa, Artificial Sequence
  Description of Artificial Sequence: Synthetic peptide
  XENP019801 vlCDR1
RASQSVGSSYLA

SEQ ID NO: 5343 - protein, 7 aa, Artificial Sequence
  Description of Artificial Sequence: Synthetic peptide
  XENP019801 vlCDR2
GAFSRAT

SEQ ID NO: 5344 - protein, 9 aa, Artificial Sequence
  Description of Artificial Sequence: Synthetic peptide
  XENP019801 vlCDR3
QQYGSSPWT

SEQ ID NO: 5345 - protein, 246 aa, Artificial Sequence
  Description of Artificial Sequence: Synthetic polypeptide
  XENP019802 [CTLA-4]_H0.54_L0_scFv(GKPGS)4
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5346 - protein, 118 aa, Artificial Sequence
  Description of Artificial Sequence: Synthetic polypeptide
  VH of XENP019802
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSS

SEQ ID NO: 5347 - protein, 108 aa, Artificial Sequence; identical to SEQ ID NO: 3741
  Description of Artificial Sequence: Synthetic polypeptide
  VL of XENP019802

SEQ ID NO: 5348 - protein, 5 aa, Artificial Sequence
  Description of Artificial Sequence: Synthetic peptide
  XENP019802 vhCDR1
SYTMH

SEQ ID NO: 5349 - protein, 17 aa, Artificial Sequence
  Description of Artificial Sequence: Synthetic peptide
  XENP019802 vhCDR2
FISGDGNNKYYADSVKG

SEQ ID NO: 5350 - protein, 9 aa, Artificial Sequence
  Description of Artificial Sequence: Synthetic peptide
  XENP019802 vhCDR3
TGWLGPFDY

SEQ ID NO: 5351 - protein, 12 aa, Artificial Sequence
  Description of Artificial Sequence: Synthetic peptide
  XENP019802 vlCDR1
RASQSVGSSYLA

SEQ ID NO: 5352 - protein, 7 aa, Artificial Sequence
  Description of Artificial Sequence: Synthetic peptide
  XENP019802 vlCDR2
GAFSRAT

SEQ ID NO: 5353 - protein, 9 aa, Artificial Sequence
  Description of Artificial Sequence: Synthetic peptide
  XENP019802 vlCDR3
QQYGSSPWT

SEQ ID NO: 5354 - protein, 246 aa, Artificial Sequence
  Description of Artificial Sequence: Synthetic polypeptide
  XENP019803 [CTLA-4]_H0.55_L0_scFv(GKPGS)4
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5355 - protein, 118 aa, Artificial Sequence
  Description of Artificial Sequence: Synthetic polypeptide
  VH of XENP019803
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSS

SEQ ID NO: 5356 - protein, 108 aa, Artificial Sequence; identical to SEQ ID NO: 3741
  Description of Artificial Sequence: Synthetic polypeptide
  VL of XENP019803

SEQ ID NO: 5357 - protein, 5 aa, Artificial Sequence
  Description of Artificial Sequence: Synthetic peptide
  XENP019803 vhCDR1
SYTMH

SEQ ID NO: 5358 - protein, 17 aa, Artificial Sequence
  Description of Artificial Sequence: Synthetic peptide
  XENP019803 vhCDR2
FISNDGNNKYYADSVKG

SEQ ID NO: 5359 - protein, 9 aa, Artificial Sequence
  Description of Artificial Sequence: Synthetic peptide
  XENP019803 vhCDR3
TGWLGPFDY

SEQ ID NO: 5360 - protein, 12 aa, Artificial Sequence
  Description of Artificial Sequence: Synthetic peptide
  XENP019803 vlCDR1
RASQSVGSSYLA

SEQ ID NO: 5361 - protein, 7 aa, Artificial Sequence
  Description of Artificial Sequence: Synthetic peptide
  XENP019803 vlCDR2
GAFSRAT

SEQ ID NO: 5362 - protein, 9 aa, Artificial Sequence
  Description of Artificial Sequence: Synthetic peptide
  XENP019803 vlCDR3
QQYGSSPWT

SEQ ID NO: 5363 - protein, 246 aa, Artificial Sequence
  Description of Artificial Sequence: Synthetic polypeptide
  XENP019804 [CTLA-4]_H0.56_L0_scFv(GKPGS)4
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5364 - protein, 118 aa, Artificial Sequence
  Description of Artificial Sequence: Synthetic polypeptide
  VH of XENP019804
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSS

SEQ ID NO: 5365 - protein, 108 aa, Artificial Sequence; identical to SEQ ID NO: 3741
  Description of Artificial Sequence: Synthetic polypeptide
  VL of XENP019804

SEQ ID NO: 5366 - protein, 5 aa, Artificial Sequence
  Description of Artificial Sequence: Synthetic peptide
  XENP019804 vhCDR1
SYTMH

SEQ ID NO: 5367 - protein, 17 aa, Artificial Sequence
  Description of Artificial Sequence: Synthetic peptide
  XENP019804 vhCDR2
FISSDGNNKYYADSVKG

SEQ ID NO: 5368 - protein, 9 aa, Artificial Sequence
  Description of Artificial Sequence: Synthetic peptide
  XENP019804 vhCDR3
TGWLGPFDY

SEQ ID NO: 5369 - protein, 12 aa, Artificial Sequence
  Description of Artificial Sequence: Synthetic peptide
  XENP019804 vlCDR1
RASQSVGSSYLA

SEQ ID NO: 5370 - protein, 7 aa, Artificial Sequence
  Description of Artificial Sequence: Synthetic peptide
  XENP019804 vlCDR2
GAFSRAT

SEQ ID NO: 5371 - protein, 9 aa, Artificial Sequence
  Description of Artificial Sequence: Synthetic peptide
  XENP019804 vlCDR3
QQYGSSPWT

SEQ ID NO: 5372 - protein, 246 aa, Artificial Sequence
  Description of Artificial Sequence: Synthetic polypeptide
  XENP019805 [CTLA-4]_H0.57_L0_scFv(GKPGS)4
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5373 - protein, 118 aa, Artificial Sequence
  Description of Artificial Sequence: Synthetic polypeptide
  VH of XENP019805
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSS

SEQ ID NO: 5374 - protein, 108 aa, Artificial Sequence; identical to SEQ ID NO: 3741
  Description of Artificial Sequence: Synthetic polypeptide
  VL of XENP019805

SEQ ID NO: 5375 - protein, 5 aa, Artificial Sequence
  Description of Artificial Sequence: Synthetic peptide
  XENP019805 vhCDR1
SYTMH

SEQ ID NO: 5376 - protein, 17 aa, Artificial Sequence
  Description of Artificial Sequence: Synthetic peptide
  XENP019805 vhCDR2
FISYNGNNKYYADSVKG

SEQ ID NO: 5377 - protein, 9 aa, Artificial Sequence
  Description of Artificial Sequence: Synthetic peptide
  XENP019805 vhCDR3
TGWLGPFDY

SEQ ID NO: 5378 - protein, 12 aa, Artificial Sequence
  Description of Artificial Sequence: Synthetic peptide
  XENP019805 vlCDR1
RASQSVGSSYLA

SEQ ID NO: 5379 - protein, 7 aa, Artificial Sequence
  Description of Artificial Sequence: Synthetic peptide
  XENP019805 vlCDR2
GAFSRAT

SEQ ID NO: 5380 - protein, 9 aa, Artificial Sequence
  Description of Artificial Sequence: Synthetic peptide
  XENP019805 vlCDR3
QQYGSSPWT

SEQ ID NO: 5381 - protein, 246 aa, Artificial Sequence
  Description of Artificial Sequence: Synthetic polypeptide
  XENP019806 [CTLA-4]_H0.58_L0_scFv(GKPGS)4
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5382 - protein, 118 aa, Artificial Sequence
  Description of Artificial Sequence: Synthetic polypeptide
  VH of XENP019806
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSS

SEQ ID NO: 5383 - protein, 108 aa, Artificial Sequence; identical to SEQ ID NO: 3741
  Description of Artificial Sequence: Synthetic polypeptide
  VL of XENP019806

SEQ ID NO: 5384 - protein, 5 aa, Artificial Sequence
  Description of Artificial Sequence: Synthetic peptide
  XENP019806 vhCDR1
SYTMH

SEQ ID NO: 5385 - protein, 17 aa, Artificial Sequence
  Description of Artificial Sequence: Synthetic peptide
  XENP019806 vhCDR2
FISYSGNNKYYADSVKG

SEQ ID NO: 5386 - protein, 9 aa, Artificial Sequence
  Description of Artificial Sequence: Synthetic peptide
  XENP019806 vhCDR3
TGWLGPFDY

SEQ ID NO: 5387 - protein, 12 aa, Artificial Sequence
  Description of Artificial Sequence: Synthetic peptide
  XENP019806 vlCDR1
RASQSVGSSYLA

SEQ ID NO: 5388 - protein, 7 aa, Artificial Sequence
  Description of Artificial Sequence: Synthetic peptide
  XENP019806 vlCDR2
GAFSRAT

SEQ ID NO: 5389 - protein, 9 aa, Artificial Sequence
  Description of Artificial Sequence: Synthetic peptide
  XENP019806 vlCDR3
QQYGSSPWT

SEQ ID NO: 5390 - protein, 246 aa, Artificial Sequence
  Description of Artificial Sequence: Synthetic polypeptide
  XENP019807 [CTLA-4]_H0.59_L0_scFv(GKPGS)4
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5391 - protein, 118 aa, Artificial Sequence
  Description of Artificial Sequence: Synthetic polypeptide
  VH of XENP019807
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSS

SEQ ID NO: 5392 - protein, 108 aa, Artificial Sequence; identical to SEQ ID NO: 3741
  Description of Artificial Sequence: Synthetic polypeptide
  VL of XENP019807

SEQ ID NO: 5393 - protein, 5 aa, Artificial Sequence
  Description of Artificial Sequence: Synthetic peptide
  XENP019807 vhCDR1
SYTMH

SEQ ID NO: 5394 - protein, 17 aa, Artificial Sequence
  Description of Artificial Sequence: Synthetic peptide
  XENP019807 vhCDR2
FISYEGNNKYYADSVKG

SEQ ID NO: 5395 - protein, 9 aa, Artificial Sequence
  Description of Artificial Sequence: Synthetic peptide
  XENP019807 vhCDR3
TGWLGPFDY

SEQ ID NO: 5396 - protein, 12 aa, Artificial Sequence
  Description of Artificial Sequence: Synthetic peptide
  XENP019807 vlCDR1
RASQSVGSSYLA

SEQ ID NO: 5397 - protein, 7 aa, Artificial Sequence
  Description of Artificial Sequence: Synthetic peptide
  XENP019807 vlCDR2
GAFSRAT

SEQ ID NO: 5398 - protein, 9 aa, Artificial Sequence
  Description of Artificial Sequence: Synthetic peptide
  XENP019807 vlCDR3
QQYGSSPWT

SEQ ID NO: 5399 - protein, 246 aa, Artificial Sequence
  Description of Artificial Sequence: Synthetic polypeptide
  XENP019808 [CTLA-4]_H0.60_L0_scFv(GKPGS)4
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5400 - protein, 118 aa, Artificial Sequence
  Description of Artificial Sequence: Synthetic polypeptide
  VH of XENP019808
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSS

SEQ ID NO: 5401 - protein, 108 aa, Artificial Sequence; identical to SEQ ID NO: 3741
  Description of Artificial Sequence: Synthetic polypeptide
  VL of XENP019808

SEQ ID NO: 5402 - protein, 5 aa, Artificial Sequence
  Description of Artificial Sequence: Synthetic peptide
  XENP019808 vhCDR1
SYTMH

SEQ ID NO: 5403 - protein, 17 aa, Artificial Sequence
  Description of Artificial Sequence: Synthetic peptide
  XENP019808 vhCDR2
FISYHGNNKYYADSVKG

SEQ ID NO: 5404 - protein, 9 aa, Artificial Sequence
  Description of Artificial Sequence: Synthetic peptide
  XENP019808 vhCDR3
TGWLGPFDY

SEQ ID NO: 5405 - protein, 12 aa, Artificial Sequence
  Description of Artificial Sequence: Synthetic peptide
  XENP019808 vlCDR1
RASQSVGSSYLA

SEQ ID NO: 5406 - protein, 7 aa, Artificial Sequence
  Description of Artificial Sequence: Synthetic peptide
  XENP019808 vlCDR2
GAFSRAT

SEQ ID NO: 5407 - protein, 9 aa, Artificial Sequence
  Description of Artificial Sequence: Synthetic peptide
  XENP019808 vlCDR3
QQYGSSPWT

SEQ ID NO: 5408 - protein, 246 aa, Artificial Sequence
  Description of Artificial Sequence: Synthetic polypeptide
  XENP019809 [CTLA-4]_H0.61_L0_scFv(GKPGS)4
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5409 - protein, 118 aa, Artificial Sequence
  Description of Artificial Sequence: Synthetic polypeptide
  VH of XENP019809
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSS

SEQ ID NO: 5410 - protein, 108 aa, Artificial Sequence; identical to SEQ ID NO: 3741
  Description of Artificial Sequence: Synthetic polypeptide
  VL of XENP019809

SEQ ID NO: 5411 - protein, 5 aa, Artificial Sequence
  Description of Artificial Sequence: Synthetic peptide
  XENP019809 vhCDR1
SYTMH

SEQ ID NO: 5412 - protein, 17 aa, Artificial Sequence
  Description of Artificial Sequence: Synthetic peptide
  XENP019809 vhCDR2
FISYKGNNKYYADSVKG

SEQ ID NO: 5413 - protein, 9 aa, Artificial Sequence
  Description of Artificial Sequence: Synthetic peptide
  XENP019809 vhCDR3
TGWLGPFDY

SEQ ID NO: 5414 - protein, 12 aa, Artificial Sequence
  Description of Artificial Sequence: Synthetic peptide
  XENP019809 vlCDR1
RASQSVGSSYLA

SEQ ID NO: 5415 - protein, 7 aa, Artificial Sequence
  Description of Artificial Sequence: Synthetic peptide
  XENP019809 vlCDR2
GAFSRAT

SEQ ID NO: 5416 - protein, 9 aa, Artificial Sequence
  Description of Artificial Sequence: Synthetic peptide
  XENP019809 vlCDR3
QQYGSSPWT

SEQ ID NO: 5417 - protein, 246 aa, Artificial Sequence
  Description of Artificial Sequence: Synthetic polypeptide
  XENP019810 [CTLA-4]_H0.62_L0_scFv(GKPGS)4
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5418 - protein, 118 aa, Artificial Sequence
  Description of Artificial Sequence: Synthetic polypeptide
  VH of XENP019810
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSS

SEQ ID NO: 5419 - protein, 108 aa, Artificial Sequence; identical to SEQ ID NO: 3741
  Description of Artificial Sequence: Synthetic polypeptide
  VL of XENP019810

SEQ ID NO: 5420 - protein, 5 aa, Artificial Sequence
  Description of Artificial Sequence: Synthetic peptide
  XENP019810 vhCDR1
SYTMH

SEQ ID NO: 5421 - protein, 17 aa, Artificial Sequence
  Description of Artificial Sequence: Synthetic peptide
  XENP019810 vhCDR2
FISYKGNNKYYADSVKG

SEQ ID NO: 5422 - protein, 9 aa, Artificial Sequence
  Description of Artificial Sequence: Synthetic peptide
  XENP019810 vhCDR3
TGWLGPFDY

SEQ ID NO: 5423 - protein, 12 aa, Artificial Sequence
  Description of Artificial Sequence: Synthetic peptide
  XENP019810 vlCDR1
RASQSVGSSYLA

SEQ ID NO: 5424 - protein, 7 aa, Artificial Sequence
  Description of Artificial Sequence: Synthetic peptide
  XENP019810 vlCDR2
GAFSRAT

SEQ ID NO: 5425 - protein, 9 aa, Artificial Sequence
  Description of Artificial Sequence: Synthetic peptide
  XENP019810 vlCDR3
QQYGSSPWT

SEQ ID NO: 5426 - protein, 246 aa, Artificial Sequence
  Description of Artificial Sequence: Synthetic polypeptide
  XENP019811 [CTLA-4]_H0.63_L0_scFv(GKPGS)4
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5427 - protein, 118 aa, Artificial Sequence
  Description of Artificial Sequence: Synthetic polypeptide
  VH of XENP019811
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSS

SEQ ID NO: 5428 - protein, 108 aa, Artificial Sequence; identical to SEQ ID NO: 3741
  Description of Artificial Sequence: Synthetic polypeptide
  VL of XENP019811

SEQ ID NO: 5429 - protein, 5 aa, Artificial Sequence
  Description of Artificial Sequence: Synthetic peptide
  XENP019811 vhCDR1
SYTMH

SEQ ID NO: 5430 - protein, 17 aa, Artificial Sequence
  Description of Artificial Sequence: Synthetic peptide
  XENP019811 vhCDR2
FISYQGNNKYYADSVKG

SEQ ID NO: 5431 - protein, 9 aa, Artificial Sequence
  Description of Artificial Sequence: Synthetic peptide
  XENP019811 vhCDR3
TGWLGPFDY

SEQ ID NO: 5432 - protein, 12 aa, Artificial Sequence
  Description of Artificial Sequence: Synthetic peptide
  XENP019811 vlCDR1
RASQSVGSSYLA

SEQ ID NO: 5433 - protein, 7 aa, Artificial Sequence
  Description of Artificial Sequence: Synthetic peptide
  XENP019811 vlCDR2
GAFSRAT

SEQ ID NO: 5434 - protein, 9 aa, Artificial Sequence
  Description of Artificial Sequence: Synthetic peptide
  XENP019811 vlCDR3
QQYGSSPWT

SEQ ID NO: 5435 - protein, 246 aa, Artificial Sequence
  Description of Artificial Sequence: Synthetic polypeptide
  XENP019812 [CTLA-4]_H0.64_L0_scFv(GKPGS)4
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5436 - protein, 118 aa, Artificial Sequence
  Description of Artificial Sequence: Synthetic polypeptide
  VH of XENP019812
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSS

SEQ ID NO: 5437 - protein, 108 aa, Artificial Sequence; identical to SEQ ID NO: 3741
  Description of Artificial Sequence: Synthetic polypeptide
  VL of XENP019812

SEQ ID NO: 5438 - protein, 5 aa, Artificial Sequence
  Description of Artificial Sequence: Synthetic peptide
  XENP019812 vhCDR1
SYTMH

SEQ ID NO: 5439 - protein, 17 aa, Artificial Sequence
  Description of Artificial Sequence: Synthetic peptide
  XENP019812 vhCDR2
FISYDKNNKYYADSVKG

SEQ ID NO: 5440 - protein, 9 aa, Artificial Sequence
  Description of Artificial Sequence: Synthetic peptide
  XENP019812 vhCDR3
TGWLGPFDY

SEQ ID NO: 5441 - protein, 12 aa, Artificial Sequence
  Description of Artificial Sequence: Synthetic peptide
  XENP019812 vlCDR1
RASQSVGSSYLA

SEQ ID NO: 5442 - protein, 7 aa, Artificial Sequence
  Description of Artificial Sequence: Synthetic peptide
  XENP019812 vlCDR2
GAFSRAT

SEQ ID NO: 5443 - protein, 9 aa, Artificial Sequence
  Description of Artificial Sequence: Synthetic peptide
  XENP019812 vlCDR3
QQYGSSPWT

SEQ ID NO: 5444 - protein, 246 aa, Artificial Sequence
  Description of Artificial Sequence: Synthetic polypeptide
  XENP019813 [CTLA-4]_H0.65_L0_scFv(GKPGS)4
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5445 - protein, 118 aa, Artificial Sequence
  Description of Artificial Sequence: Synthetic polypeptide
  VH of XENP019813
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSS

SEQ ID NO: 5446 - protein, 108 aa, Artificial Sequence; identical to SEQ ID NO: 3741
  Description of Artificial Sequence: Synthetic polypeptide
  VL of XENP019813

SEQ ID NO: 5447 - protein, 5 aa, Artificial Sequence
  Description of Artificial Sequence: Synthetic peptide
  XENP019813 vhCDR1
SYTMH

SEQ ID NO: 5448 - protein, 17 aa, Artificial Sequence
  Description of Artificial Sequence: Synthetic peptide
  XENP019813 vhCDR2
FISYDKNNKYYADSVKG

SEQ ID NO: 5449 - protein, 9 aa, Artificial Sequence
  Description of Artificial Sequence: Synthetic peptide
  XENP019813 vhCDR3
TGWLGPFDY

SEQ ID NO: 5450 - protein, 12 aa, Artificial Sequence
  Description of Artificial Sequence: Synthetic peptide
  XENP019813 vlCDR1
RASQSVGSSYLA

SEQ ID NO: 5451 - protein, 7 aa, Artificial Sequence
  Description of Artificial Sequence: Synthetic peptide
  XENP019813 vlCDR2
GAFSRAT

SEQ ID NO: 5452 - protein, 9 aa, Artificial Sequence
  Description of Artificial Sequence: Synthetic peptide
  XENP019813 vlCDR3
QQYGSSPWT

SEQ ID NO: 5453 - protein, 246 aa, Artificial Sequence
  Description of Artificial Sequence: Synthetic polypeptide
  XENP019814 [CTLA-4]_H0.66_L0_scFv(GKPGS)4
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5454 - protein, 118 aa, Artificial Sequence
  Description of Artificial Sequence: Synthetic polypeptide
  VH of XENP019814
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSS

SEQ ID NO: 5455 - protein, 108 aa, Artificial Sequence; identical to SEQ ID NO: 3741
  Description of Artificial Sequence: Synthetic polypeptide
  VL of XENP019814

SEQ ID NO: 5456 - protein, 5 aa, Artificial Sequence
  Description of Artificial Sequence: Synthetic peptide
  XENP019814 vhCDR1
SYTMH

SEQ ID NO: 5457 - protein, 17 aa, Artificial Sequence
  Description of Artificial Sequence: Synthetic peptide
  XENP019814 vhCDR2
FISYDGDNKYYADSVKG

SEQ ID NO: 5458 - protein, 9 aa, Artificial Sequence
  Description of Artificial Sequence: Synthetic peptide
  XENP019814 vhCDR3
TGWLGPFDY

SEQ ID NO: 5459 - protein, 12 aa, Artificial Sequence
  Description of Artificial Sequence: Synthetic peptide
  XENP019814 vlCDR1
RASQSVGSSYLA

SEQ ID NO: 5460 - protein, 7 aa, Artificial Sequence
  Description of Artificial Sequence: Synthetic peptide
  XENP019814 vlCDR2
GAFSRAT

SEQ ID NO: 5461 - protein, 9 aa, Artificial Sequence
  Description of Artificial Sequence: Synthetic peptide
  XENP019814 vlCDR3
QQYGSSPWT

SEQ ID NO: 5462 - protein, 246 aa, Artificial Sequence
  Description of Artificial Sequence: Synthetic polypeptide
  XENP019815 [CTLA-4]_H0.67_L0_scFv(GKPGS)4
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5463 - protein, 118 aa, Artificial Sequence
  Description of Artificial Sequence: Synthetic polypeptide
  VH of XENP019815
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSS

SEQ ID NO: 5464 - protein, 108 aa, Artificial Sequence; identical to SEQ ID NO: 3741
  Description of Artificial Sequence: Synthetic polypeptide
  VL of XENP019815

SEQ ID NO: 5465 - protein, 5 aa, Artificial Sequence
  Description of Artificial Sequence: Synthetic peptide
  XENP019815 vhCDR1
SYTMH

SEQ ID NO: 5466 - protein, 17 aa, Artificial Sequence
  Description of Artificial Sequence: Synthetic peptide
  XENP019815 vhCDR2
FISYDGGNKYYADSVKG

SEQ ID NO: 5467 - protein, 9 aa, Artificial Sequence
  Description of Artificial Sequence: Synthetic peptide
  XENP019815 vhCDR3
TGWLGPFDY

SEQ ID NO: 5468 - protein, 12 aa, Artificial Sequence
  Description of Artificial Sequence: Synthetic peptide
  XENP019815 vlCDR1
RASQSVGSSYLA

SEQ ID NO: 5469 - protein, 7 aa, Artificial Sequence
  Description of Artificial Sequence: Synthetic peptide
  XENP019815 vlCDR2
GAFSRAT

SEQ ID NO: 5470 - protein, 9 aa, Artificial Sequence
  Description of Artificial Sequence: Synthetic peptide
  XENP019815 vlCDR3
QQYGSSPWT

SEQ ID NO: 5471 - protein, 246 aa, Artificial Sequence
  Description of Artificial Sequence: Synthetic polypeptide
  XENP019816 [CTLA-4]_H0.68_L0_scFv(GKPGS)4
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5472 - protein, 118 aa, Artificial Sequence
  Description of Artificial Sequence: Synthetic polypeptide
  VH of XENP019816
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSS

SEQ ID NO: 5473 - protein, 108 aa, Artificial Sequence; identical to SEQ ID NO: 3741
  Description of Artificial Sequence: Synthetic polypeptide
  VL of XENP019816

SEQ ID NO: 5474 - protein, 5 aa, Artificial Sequence
  Description of Artificial Sequence: Synthetic peptide
  XENP019816 vhCDR1
SYTMH

SEQ ID NO: 5475 - protein, 17 aa, Artificial Sequence
  Description of Artificial Sequence: Synthetic peptide
  XENP019816 vhCDR2
FISYDGHNKYYADSVKG

SEQ ID NO: 5476 - protein, 9 aa, Artificial Sequence
  Description of Artificial Sequence: Synthetic peptide
  XENP019816 vhCDR3
TGWLGPFDY

SEQ ID NO: 5477 - protein, 12 aa, Artificial Sequence
  Description of Artificial Sequence: Synthetic peptide
  XENP019816 vlCDR1
RASQSVGSSYLA

SEQ ID NO: 5478 - protein, 7 aa, Artificial Sequence
  Description of Artificial Sequence: Synthetic peptide
  XENP019816 vlCDR2
GAFSRAT

SEQ ID NO: 5479 - protein, 9 aa, Artificial Sequence
  Description of Artificial Sequence: Synthetic peptide
  XENP019816 vlCDR3
QQYGSSPWT

SEQ ID NO: 5480 - protein, 246 aa, Artificial Sequence
  Description of Artificial Sequence: Synthetic polypeptide
  XENP019817 [CTLA-4]_H0.69_L0_scFv(GKPGS)4
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5481 - protein, 118 aa, Artificial Sequence
  Description of Artificial Sequence: Synthetic polypeptide
  VH of XENP019817
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSS

SEQ ID NO: 5482 - protein, 108 aa, Artificial Sequence; identical to SEQ ID NO: 3741
  Description of Artificial Sequence: Synthetic polypeptide
  VL of XENP019817

SEQ ID NO: 5483 - protein, 5 aa, Artificial Sequence
  Description of Artificial Sequence: Synthetic peptide
  XENP019817 vhCDR1
SYTMH

SEQ ID NO: 5484 - protein, 17 aa, Artificial Sequence
  Description of Artificial Sequence: Synthetic peptide
  XENP019817 vhCDR2
FISYDGQNKYYADSVKG

SEQ ID NO: 5485 - protein, 9 aa, Artificial Sequence
  Description of Artificial Sequence: Synthetic peptide
  XENP019817 vhCDR3
TGWLGPFDY

SEQ ID NO: 5486 - protein, 12 aa, Artificial Sequence
  Description of Artificial Sequence: Synthetic peptide
  XENP019817 vlCDR1
RASQSVGSSYLA

SEQ ID NO: 5487 - protein, 7 aa, Artificial Sequence
  Description of Artificial Sequence: Synthetic peptide
  XENP019817 vlCDR2
GAFSRAT

SEQ ID NO: 5488 - protein, 9 aa, Artificial Sequence
  Description of Artificial Sequence: Synthetic peptide
  XENP019817 vlCDR3
QQYGSSPWT

SEQ ID NO: 5489 - protein, 246 aa, Artificial Sequence
  Description of Artificial Sequence: Synthetic polypeptide
  XENP019818 [CTLA-4]_H0.70_L0_scFv(GKPGS)4
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5490 - protein, 118 aa, Artificial Sequence
  Description of Artificial Sequence: Synthetic polypeptide
  VH of XENP019818
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSS

SEQ ID NO: 5491 - protein, 108 aa, Artificial Sequence; identical to SEQ ID NO: 3741
  Description of Artificial Sequence: Synthetic polypeptide
  VL of XENP019818

SEQ ID NO: 5492 - protein, 5 aa, Artificial Sequence
  Description of Artificial Sequence: Synthetic peptide
  XENP019818 vhCDR1
SYTMH

SEQ ID NO: 5493 - protein, 17 aa, Artificial Sequence
  Description of Artificial Sequence: Synthetic peptide
  XENP019818 vhCDR2
FISYDGSNKYYADSVKG

SEQ ID NO: 5494 - protein, 9 aa, Artificial Sequence
  Description of Artificial Sequence: Synthetic peptide
  XENP019818 vhCDR3
TGWLGPFDY

SEQ ID NO: 5495 - protein, 12 aa, Artificial Sequence
  Description of Artificial Sequence: Synthetic peptide
  XENP019818 vlCDR1
RASQSVGSSYLA

SEQ ID NO: 5496 - protein, 7 aa, Artificial Sequence
  Description of Artificial Sequence: Synthetic peptide
  XENP019818 vlCDR2
GAFSRAT

SEQ ID NO: 5497 - protein, 9 aa, Artificial Sequence
  Description of Artificial Sequence: Synthetic peptide
  XENP019818 vlCDR3
QQYGSSPWT

SEQ ID NO: 5498 - protein, 246 aa, Artificial Sequence
  Description of Artificial Sequence: Synthetic polypeptide
  XENP019819 [CTLA-4]_H0.71_L0_scFv(GKPGS)4
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5499 - protein, 118 aa, Artificial Sequence
  Description of Artificial Sequence: Synthetic polypeptide
  VH of XENP019819
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSS

SEQ ID NO: 5500 - protein, 108 aa, Artificial Sequence; identical to SEQ ID NO: 3741
  Description of Artificial Sequence: Synthetic polypeptide
  VL of XENP019819

SEQ ID NO: 5501 - protein, 5 aa, Artificial Sequence
  Description of Artificial Sequence: Synthetic peptide
  XENP019819 vhCDR1
SYTMH

SEQ ID NO: 5502 - protein, 17 aa, Artificial Sequence
  Description of Artificial Sequence: Synthetic peptide
  XENP019819 vhCDR2
FISYDGNDKYYADSVKG

SEQ ID NO: 5503 - protein, 9 aa, Artificial Sequence
  Description of Artificial Sequence: Synthetic peptide
  XENP019819 vhCDR3
TGWLGPFDY

SEQ ID NO: 5504 - protein, 12 aa, Artificial Sequence
  Description of Artificial Sequence: Synthetic peptide
  XENP019819 vlCDR1
RASQSVGSSYLA

SEQ ID NO: 5505 - protein, 7 aa, Artificial Sequence
  Description of Artificial Sequence: Synthetic peptide
  XENP019819 vlCDR2
GAFSRAT

SEQ ID NO: 5506 - protein, 9 aa, Artificial Sequence
  Description of Artificial Sequence: Synthetic peptide
  XENP019819 vlCDR3
QQYGSSPWT

SEQ ID NO: 5507 - protein, 246 aa, Artificial Sequence
  Description of Artificial Sequence: Synthetic polypeptide
  XENP019820 [CTLA-4]_H0.72_L0_scFv(GKPGS)4
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5508 - protein, 118 aa, Artificial Sequence
  Description of Artificial Sequence: Synthetic polypeptide
  VH of XENP019820
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSS

SEQ ID NO: 5509 - protein, 108 aa, Artificial Sequence; identical to SEQ ID NO: 3741
  Description of Artificial Sequence: Synthetic polypeptide
  VL of XENP019820

SEQ ID NO: 5510 - protein, 5 aa, Artificial Sequence
  Description of Artificial Sequence: Synthetic peptide
  XENP019820 vhCDR1
SYTMH

SEQ ID NO: 5511 - protein, 17 aa, Artificial Sequence
  Description of Artificial Sequence: Synthetic peptide
  XENP019820 vhCDR2
FISYDGNEKYYADSVKG

SEQ ID NO: 5512 - protein, 9 aa, Artificial Sequence
  Description of Artificial Sequence: Synthetic peptide
  XENP019820 vhCDR3
TGWLGPFDY

SEQ ID NO: 5513 - protein, 12 aa, Artificial Sequence
  Description of Artificial Sequence: Synthetic peptide
  XENP019820 vlCDR1
RASQSVGSSYLA

SEQ ID NO: 5514 - protein, 7 aa, Artificial Sequence
  Description of Artificial Sequence: Synthetic peptide
  XENP019820 vlCDR2
GAFSRAT

SEQ ID NO: 5515 - protein, 9 aa, Artificial Sequence
  Description of Artificial Sequence: Synthetic peptide
  XENP019820 vlCDR3
QQYGSSPWT

SEQ ID NO: 5516 - protein, 246 aa, Artificial Sequence
  Description of Artificial Sequence: Synthetic polypeptide
  XENP019821 [CTLA-4]_H0.73_L0_scFv(GKPGS)4
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5517 - protein, 118 aa, Artificial Sequence
  Description of Artificial Sequence: Synthetic polypeptide
  VH of XENP019821
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSS

SEQ ID NO: 5518 - protein, 108 aa, Artificial Sequence; identical to SEQ ID NO: 3741
  Description of Artificial Sequence: Synthetic polypeptide
  VL of XENP019821

SEQ ID NO: 5519 - protein, 5 aa, Artificial Sequence
  Description of Artificial Sequence: Synthetic peptide
  XENP019821 vhCDR1
SYTMH

SEQ ID NO: 5520 - protein, 17 aa, Artificial Sequence
  Description of Artificial Sequence: Synthetic peptide
  XENP019821 vhCDR2
FISYDGNHKYYADSVKG

SEQ ID NO: 5521 - protein, 9 aa, Artificial Sequence
  Description of Artificial Sequence: Synthetic peptide
  XENP019821 vhCDR3
TGWLGPFDY

SEQ ID NO: 5522 - protein, 12 aa, Artificial Sequence
  Description of Artificial Sequence: Synthetic peptide
  XENP019821 vlCDR1
RASQSVGSSYLA

SEQ ID NO: 5523 - protein, 7 aa, Artificial Sequence
  Description of Artificial Sequence: Synthetic peptide
  XENP019821 vlCDR2
GAFSRAT

SEQ ID NO: 5524 - protein, 9 aa, Artificial Sequence
  Description of Artificial Sequence: Synthetic peptide
  XENP019821 vlCDR3
QQYGSSPWT

SEQ ID NO: 5525 - protein, 246 aa, Artificial Sequence
  Description of Artificial Sequence: Synthetic polypeptide
  XENP019822 [CTLA-4]_H0.74_L0_scFv(GKPGS)4
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5526 - protein, 118 aa, Artificial Sequence
  Description of Artificial Sequence: Synthetic polypeptide
  VH of XENP019822
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSS

SEQ ID NO: 5527 - protein, 108 aa, Artificial Sequence; identical to SEQ ID NO: 3741
  Description of Artificial Sequence: Synthetic polypeptide
  VL of XENP019822

SEQ ID NO: 5528 - protein, 5 aa, Artificial Sequence
  Description of Artificial Sequence: Synthetic peptide
  XENP019822 vhCDR1
SYTMH

SEQ ID NO: 5529 - protein, 17 aa, Artificial Sequence
  Description of Artificial Sequence: Synthetic peptide
  XENP019822 vhCDR2
FISYDGNSKYYADSVKG

SEQ ID NO: 5530 - protein, 9 aa, Artificial Sequence
  Description of Artificial Sequence: Synthetic peptide
  XENP019822 vhCDR3
TGWLGPFDY

SEQ ID NO: 5531 - protein, 12 aa, Artificial Sequence
  Description of Artificial Sequence: Synthetic peptide
  XENP019822 vlCDR1
RASQSVGSSYLA

SEQ ID NO: 5532 - protein, 7 aa, Artificial Sequence
  Description of Artificial Sequence: Synthetic peptide
  XENP019822 vlCDR2
GAFSRAT

SEQ ID NO: 5533 - protein, 9 aa, Artificial Sequence
  Description of Artificial Sequence: Synthetic peptide
  XENP019822 vlCDR3
QQYGSSPWT

SEQ ID NO: 5534 - protein, 246 aa, Artificial Sequence
  Description of Artificial Sequence: Synthetic polypeptide
  XENP019823 [CTLA-4]_H0.75_L0_scFv(GKPGS)4
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5535 - protein, 118 aa, Artificial Sequence
  Description of Artificial Sequence: Synthetic polypeptide
  VH of XENP019823
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSS

SEQ ID NO: 5536 - protein, 108 aa, Artificial Sequence; identical to SEQ ID NO: 3741
  Description of Artificial Sequence: Synthetic polypeptide
  VL of XENP019823

SEQ ID NO: 5537 - protein, 5 aa, Artificial Sequence
  Description of Artificial Sequence: Synthetic peptide
  XENP019823 vhCDR1
SYTMH

SEQ ID NO: 5538 - protein, 17 aa, Artificial Sequence
  Description of Artificial Sequence: Synthetic peptide
  XENP019823 vhCDR2
FISYDGNTKYYADSVKG

SEQ ID NO: 5539 - protein, 9 aa, Artificial Sequence
  Description of Artificial Sequence: Synthetic peptide
  XENP019823 vhCDR3
TGWLGPFDY

SEQ ID NO: 5540 - protein, 12 aa, Artificial Sequence
  Description of Artificial Sequence: Synthetic peptide
  XENP019823 vlCDR1
RASQSVGSSYLA

SEQ ID NO: 5541 - protein, 7 aa, Artificial Sequence
  Description of Artificial Sequence: Synthetic peptide
  XENP019823 vlCDR2
GAFSRAT

SEQ ID NO: 5542 - protein, 9 aa, Artificial Sequence
  Description of Artificial Sequence: Synthetic peptide
  XENP019823 vlCDR3
QQYGSSPWT

SEQ ID NO: 5543 - protein, 246 aa, Artificial Sequence
  Description of Artificial Sequence: Synthetic polypeptide
  XENP019824 [CTLA-4]_H0.76_L0_scFv(GKPGS)4
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5544 - protein, 118 aa, Artificial Sequence
  Description of Artificial Sequence: Synthetic polypeptide
  VH of XENP019824
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSS

SEQ ID NO: 5545 - protein, 108 aa, Artificial Sequence; identical to SEQ ID NO: 3741
  Description of Artificial Sequence: Synthetic polypeptide
  VL of XENP019824

SEQ ID NO: 5546 - protein, 5 aa, Artificial Sequence
  Description of Artificial Sequence: Synthetic peptide
  XENP019824 vhCDR1
SYTMH

SEQ ID NO: 5547 - protein, 17 aa, Artificial Sequence
  Description of Artificial Sequence: Synthetic peptide
  XENP019824 vhCDR2
FISYDGNQKYYADSVKG

SEQ ID NO: 5548 - protein, 9 aa, Artificial Sequence
  Description of Artificial Sequence: Synthetic peptide
  XENP019824 vhCDR3
TGWLGPFDY

SEQ ID NO: 5549 - protein, 12 aa, Artificial Sequence
  Description of Artificial Sequence: Synthetic peptide
  XENP019824 vlCDR1
RASQSVGSSYLA

SEQ ID NO: 5550 - protein, 7 aa, Artificial Sequence
  Description of Artificial Sequence: Synthetic peptide
  XENP019824 vlCDR2
GAFSRAT

SEQ ID NO: 5551 - protein, 9 aa, Artificial Sequence
  Description of Artificial Sequence: Synthetic peptide
  XENP019824 vlCDR3
QQYGSSPWT

SEQ ID NO: 5552 - protein, 246 aa, Artificial Sequence
  Description of Artificial Sequence: Synthetic polypeptide
  XENP019825 [CTLA-4]_H0.77_L0_scFv(GKPGS)4
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5553 - protein, 118 aa, Artificial Sequence
  Description of Artificial Sequence: Synthetic polypeptide
  VH of XENP019825
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSS

SEQ ID NO: 5554 - protein, 108 aa, Artificial Sequence; identical to SEQ ID NO: 3741
  Description of Artificial Sequence: Synthetic polypeptide
  VL of XENP019825

SEQ ID NO: 5555 - protein, 5 aa, Artificial Sequence
  Description of Artificial Sequence: Synthetic peptide
  XENP019825 vhCDR1
SYTMH

SEQ ID NO: 5556 - protein, 17 aa, Artificial Sequence
  Description of Artificial Sequence: Synthetic peptide
  XENP019825 vhCDR2
FISYDGNNIYYADSVKG

SEQ ID NO: 5557 - protein, 9 aa, Artificial Sequence
  Description of Artificial Sequence: Synthetic peptide
  XENP019825 vhCDR3
TGWLGPFDY

SEQ ID NO: 5558 - protein, 12 aa, Artificial Sequence
  Description of Artificial Sequence: Synthetic peptide
  XENP019825 vlCDR1
RASQSVGSSYLA

SEQ ID NO: 5559 - protein, 7 aa, Artificial Sequence
  Description of Artificial Sequence: Synthetic peptide
  XENP019825 vlCDR2
GAFSRAT

SEQ ID NO: 5560 - protein, 9 aa, Artificial Sequence
  Description of Artificial Sequence: Synthetic peptide
  XENP019825 vlCDR3
QQYGSSPWT

SEQ ID NO: 5561 - protein, 246 aa, Artificial Sequence
  Description of Artificial Sequence: Synthetic polypeptide
  XENP019826 [CTLA-4]_H0.78_L0_scFv(GKPGS)4
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5562 - protein, 118 aa, Artificial Sequence
  Description of Artificial Sequence: Synthetic polypeptide
  VH of XENP019826
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSS

SEQ ID NO: 5563 - protein, 108 aa, Artificial Sequence; identical to SEQ ID NO: 3741
  Description of Artificial Sequence: Synthetic polypeptide
  VL of XENP019826

SEQ ID NO: 5564 - protein, 5 aa, Artificial Sequence
  Description of Artificial Sequence: Synthetic peptide
  XENP019826 vhCDR1
SYTMH

SEQ ID NO: 5565 - protein, 17 aa, Artificial Sequence
  Description of Artificial Sequence: Synthetic peptide
  XENP019826 vhCDR2
FISYDGNNTYYADSVKG

SEQ ID NO: 5566 - protein, 9 aa, Artificial Sequence
  Description of Artificial Sequence: Synthetic peptide
  XENP019826 vhCDR3
TGWLGPFDY

SEQ ID NO: 5567 - protein, 12 aa, Artificial Sequence
  Description of Artificial Sequence: Synthetic peptide
  XENP019826 vlCDR1
RASQSVGSSYLA

SEQ ID NO: 5568 - protein, 7 aa, Artificial Sequence
  Description of Artificial Sequence: Synthetic peptide
  XENP019826 vlCDR2
GAFSRAT

SEQ ID NO: 5569 - protein, 9 aa, Artificial Sequence
  Description of Artificial Sequence: Synthetic peptide
  XENP019826 vlCDR3
QQYGSSPWT

SEQ ID NO: 5570 - protein, 246 aa, Artificial Sequence
  Description of Artificial Sequence: Synthetic polypeptide
  XENP019827 [CTLA-4]_H0.79_L0_scFv(GKPGS)4
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5571 - protein, 118 aa, Artificial Sequence
  Description of Artificial Sequence: Synthetic polypeptide
  VH of XENP019827
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSS

SEQ ID NO: 5572 - protein, 108 aa, Artificial Sequence; identical to SEQ ID NO: 3741
  Description of Artificial Sequence: Synthetic polypeptide
  VL of XENP019827

SEQ ID NO: 5573 - protein, 5 aa, Artificial Sequence
  Description of Artificial Sequence: Synthetic peptide
  XENP019827 vhCDR1
SYTMH

SEQ ID NO: 5574 - protein, 17 aa, Artificial Sequence
  Description of Artificial Sequence: Synthetic peptide
  XENP019827 vhCDR2
FISYDGNNKAYADSVKG

SEQ ID NO: 5575 - protein, 9 aa, Artificial Sequence
  Description of Artificial Sequence: Synthetic peptide
  XENP019827 vhCDR3
TGWLGPFDY

SEQ ID NO: 5576 - protein, 12 aa, Artificial Sequence
  Description of Artificial Sequence: Synthetic peptide
  XENP019827 vlCDR1
RASQSVGSSYLA

SEQ ID NO: 5577 - protein, 7 aa, Artificial Sequence
  Description of Artificial Sequence: Synthetic peptide
  XENP019827 vlCDR2
GAFSRAT

SEQ ID NO: 5578 - protein, 9 aa, Artificial Sequence
  Description of Artificial Sequence: Synthetic peptide
  XENP019827 vlCDR3
QQYGSSPWT

SEQ ID NO: 5579 - protein, 246 aa, Artificial Sequence
  Description of Artificial Sequence: Synthetic polypeptide
  XENP019828 [CTLA-4]_H0.80_L0_scFv(GKPGS)4
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5580 - protein, 118 aa, Artificial Sequence
  Description of Artificial Sequence: Synthetic polypeptide
  VH of XENP019828
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSS

SEQ ID NO: 5581 - protein, 108 aa, Artificial Sequence; identical to SEQ ID NO: 3741
  Description of Artificial Sequence: Synthetic polypeptide
  VL of XENP019828

SEQ ID NO: 5582 - protein, 5 aa, Artificial Sequence
  Description of Artificial Sequence: Synthetic peptide
  XENP019828 vhCDR1
SYTMH

SEQ ID NO: 5583 - protein, 17 aa, Artificial Sequence
  Description of Artificial Sequence: Synthetic peptide
  XENP019828 vhCDR2
FISYDGNNKYYAASVKG

SEQ ID NO: 5584 - protein, 9 aa, Artificial Sequence
  Description of Artificial Sequence: Synthetic peptide
  XENP019828 vhCDR3
TGWLGPFDY

SEQ ID NO: 5585 - protein, 12 aa, Artificial Sequence
  Description of Artificial Sequence: Synthetic peptide
  XENP019828 vlCDR1
RASQSVGSSYLA

SEQ ID NO: 5586 - protein, 7 aa, Artificial Sequence
  Description of Artificial Sequence: Synthetic peptide
  XENP019828 vlCDR2
GAFSRAT

SEQ ID NO: 5587 - protein, 9 aa, Artificial Sequence
  Description of Artificial Sequence: Synthetic peptide
  XENP019828 vlCDR3
QQYGSSPWT

SEQ ID NO: 5588 - protein, 246 aa, Artificial Sequence
  Description of Artificial Sequence: Synthetic polypeptide
  XENP019829 [CTLA-4]_H0.81_L0_scFv(GKPGS)4
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5589 - protein, 118 aa, Artificial Sequence
  Description of Artificial Sequence: Synthetic polypeptide
  VH of XENP019829
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSS

SEQ ID NO: 5590 - protein, 108 aa, Artificial Sequence; identical to SEQ ID NO: 3741
  Description of Artificial Sequence: Synthetic polypeptide
  VL of XENP019829

SEQ ID NO: 5591 - protein, 5 aa, Artificial Sequence
  Description of Artificial Sequence: Synthetic peptide
  XENP019829 vhCDR1
SYTMH

SEQ ID NO: 5592 - protein, 17 aa, Artificial Sequence
  Description of Artificial Sequence: Synthetic peptide
  XENP019829 vhCDR2
FISYDGNNKYYAKSVKG

SEQ ID NO: 5593 - protein, 9 aa, Artificial Sequence
  Description of Artificial Sequence: Synthetic peptide
  XENP019829 vhCDR3
TGWLGPFDY

SEQ ID NO: 5594 - protein, 12 aa, Artificial Sequence
  Description of Artificial Sequence: Synthetic peptide
  XENP019829 vlCDR1
RASQSVGSSYLA

SEQ ID NO: 5595 - protein, 7 aa, Artificial Sequence
  Description of Artificial Sequence: Synthetic peptide
  XENP019829 vlCDR2
GAFSRAT

SEQ ID NO: 5596 - protein, 9 aa, Artificial Sequence
  Description of Artificial Sequence: Synthetic peptide
  XENP019829 vlCDR3
QQYGSSPWT

SEQ ID NO: 5597 - protein, 246 aa, Artificial Sequence
  Description of Artificial Sequence: Synthetic polypeptide
  XENP019830 [CTLA-4]_H0.82_L0_scFv(GKPGS)4
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5598 - protein, 118 aa, Artificial Sequence
  Description of Artificial Sequence: Synthetic polypeptide
  VH of XENP019830
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSS

SEQ ID NO: 5599 - protein, 108 aa, Artificial Sequence; identical to SEQ ID NO: 3741
  Description of Artificial Sequence: Synthetic polypeptide
  VL of XENP019830

SEQ ID NO: 5600 - protein, 5 aa, Artificial Sequence
  Description of Artificial Sequence: Synthetic peptide
  XENP019830 vhCDR1
SYTMH

SEQ ID NO: 5601 - protein, 17 aa, Artificial Sequence
  Description of Artificial Sequence: Synthetic peptide
  XENP019830 vhCDR2
FISYDGNNKYYADSVKD

SEQ ID NO: 5602 - protein, 9 aa, Artificial Sequence
  Description of Artificial Sequence: Synthetic peptide
  XENP019830 vhCDR3
TGWLGPFDY

SEQ ID NO: 5603 - protein, 12 aa, Artificial Sequence
  Description of Artificial Sequence: Synthetic peptide
  XENP019830 vlCDR1
RASQSVGSSYLA

SEQ ID NO: 5604 - protein, 7 aa, Artificial Sequence
  Description of Artificial Sequence: Synthetic peptide
  XENP019830 vlCDR2
GAFSRAT

SEQ ID NO: 5605 - protein, 9 aa, Artificial Sequence
  Description of Artificial Sequence: Synthetic peptide
  XENP019830 vlCDR3
QQYGSSPWT

SEQ ID NO: 5606 - protein, 246 aa, Artificial Sequence
  Description of Artificial Sequence: Synthetic polypeptide
  XENP019831 [CTLA-4]_H0.83_L0_scFv(GKPGS)4
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5607 - protein, 118 aa, Artificial Sequence
  Description of Artificial Sequence: Synthetic polypeptide
  VH of XENP019831
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSS

SEQ ID NO: 5608 - protein, 108 aa, Artificial Sequence; identical to SEQ ID NO: 3741
  Description of Artificial Sequence: Synthetic polypeptide
  VL of XENP019831

SEQ ID NO: 5609 - protein, 5 aa, Artificial Sequence
  Description of Artificial Sequence: Synthetic peptide
  XENP019831 vhCDR1
SYTMH

SEQ ID NO: 5610 - protein, 17 aa, Artificial Sequence
  Description of Artificial Sequence: Synthetic peptide
  XENP019831 vhCDR2
FISYDGNNKYYADSVKE

SEQ ID NO: 5611 - protein, 9 aa, Artificial Sequence
  Description of Artificial Sequence: Synthetic peptide
  XENP019831 vhCDR3
TGWLGPFDY

SEQ ID NO: 5612 - protein, 12 aa, Artificial Sequence
  Description of Artificial Sequence: Synthetic peptide
  XENP019831 vlCDR1
RASQSVGSSYLA

SEQ ID NO: 5613 - protein, 7 aa, Artificial Sequence
  Description of Artificial Sequence: Synthetic peptide
  XENP019831 vlCDR2
GAFSRAT

SEQ ID NO: 5614 - protein, 9 aa, Artificial Sequence
  Description of Artificial Sequence: Synthetic peptide
  XENP019831 vlCDR3
QQYGSSPWT

SEQ ID NO: 5615 - protein, 246 aa, Artificial Sequence
  Description of Artificial Sequence: Synthetic polypeptide
  XENP019832 [CTLA-4]_H0.84_L0_scFv(GKPGS)4
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5616 - protein, 118 aa, Artificial Sequence
  Description of Artificial Sequence: Synthetic polypeptide
  VH of XENP019832
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSS

SEQ ID NO: 5617 - protein, 108 aa, Artificial Sequence; identical to SEQ ID NO: 3741
  Description of Artificial Sequence: Synthetic polypeptide
  VL of XENP019832

SEQ ID NO: 5618 - protein, 5 aa, Artificial Sequence
  Description of Artificial Sequence: Synthetic peptide
  XENP019832 vhCDR1
SYTMH

SEQ ID NO: 5619 - protein, 17 aa, Artificial Sequence
  Description of Artificial Sequence: Synthetic peptide
  XENP019832 vhCDR2
FISYDGNNKYYADSVKG

SEQ ID NO: 5620 - protein, 9 aa, Artificial Sequence
  Description of Artificial Sequence: Synthetic peptide
  XENP019832 vhCDR3
TGWLGPFDY

SEQ ID NO: 5621 - protein, 12 aa, Artificial Sequence
  Description of Artificial Sequence: Synthetic peptide
  XENP019832 vlCDR1
RASQSVGSSYLA

SEQ ID NO: 5622 - protein, 7 aa, Artificial Sequence
  Description of Artificial Sequence: Synthetic peptide
  XENP019832 vlCDR2
GAFSRAT

SEQ ID NO: 5623 - protein, 9 aa, Artificial Sequence
  Description of Artificial Sequence: Synthetic peptide
  XENP019832 vlCDR3
QQYGSSPWT

SEQ ID NO: 5624 - protein, 246 aa, Artificial Sequence
  Description of Artificial Sequence: Synthetic polypeptide
  XENP019833 [CTLA-4]_H0.85_L0_scFv(GKPGS)4
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5625 - protein, 118 aa, Artificial Sequence
  Description of Artificial Sequence: Synthetic polypeptide
  VH of XENP019833
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSS

SEQ ID NO: 5626 - protein, 108 aa, Artificial Sequence; identical to SEQ ID NO: 3741
  Description of Artificial Sequence: Synthetic polypeptide
  VL of XENP019833

SEQ ID NO: 5627 - protein, 5 aa, Artificial Sequence
  Description of Artificial Sequence: Synthetic peptide
  XENP019833 vhCDR1
SYTMH

SEQ ID NO: 5628 - protein, 17 aa, Artificial Sequence
  Description of Artificial Sequence: Synthetic peptide
  XENP019833 vhCDR2
FISYDGNNKYYADSVKG

SEQ ID NO: 5629 - protein, 9 aa, Artificial Sequence
  Description of Artificial Sequence: Synthetic peptide
  XENP019833 vhCDR3
TGWLGPFDY

SEQ ID NO: 5630 - protein, 12 aa, Artificial Sequence
  Description of Artificial Sequence: Synthetic peptide
  XENP019833 vlCDR1
RASQSVGSSYLA

SEQ ID NO: 5631 - protein, 7 aa, Artificial Sequence
  Description of Artificial Sequence: Synthetic peptide
  XENP019833 vlCDR2
GAFSRAT

SEQ ID NO: 5632 - protein, 9 aa, Artificial Sequence
  Description of Artificial Sequence: Synthetic peptide
  XENP019833 vlCDR3
QQYGSSPWT

SEQ ID NO: 5633 - protein, 246 aa, Artificial Sequence
  Description of Artificial Sequence: Synthetic polypeptide
  XENP019834 [CTLA-4]_H0.86_L0_scFv(GKPGS)4
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5634 - protein, 118 aa, Artificial Sequence
  Description of Artificial Sequence: Synthetic polypeptide
  VH of XENP019834
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSS

SEQ ID NO: 5635 - protein, 108 aa, Artificial Sequence; identical to SEQ ID NO: 3741
  Description of Artificial Sequence: Synthetic polypeptide
  VL of XENP019834

SEQ ID NO: 5636 - protein, 5 aa, Artificial Sequence
  Description of Artificial Sequence: Synthetic peptide
  XENP019834 vhCDR1
SYTMH

SEQ ID NO: 5637 - protein, 17 aa, Artificial Sequence
  Description of Artificial Sequence: Synthetic peptide
  XENP019834 vhCDR2
FISYDGNNKYYADSVKG

SEQ ID NO: 5638 - protein, 9 aa, Artificial Sequence
  Description of Artificial Sequence: Synthetic peptide
  XENP019834 vhCDR3
TGWLGPFDY

SEQ ID NO: 5639 - protein, 12 aa, Artificial Sequence
  Description of Artificial Sequence: Synthetic peptide
  XENP019834 vlCDR1
RASQSVGSSYLA

SEQ ID NO: 5640 - protein, 7 aa, Artificial Sequence
  Description of Artificial Sequence: Synthetic peptide
  XENP019834 vlCDR2
GAFSRAT

SEQ ID NO: 5641 - protein, 9 aa, Artificial Sequence
  Description of Artificial Sequence: Synthetic peptide
  XENP019834 vlCDR3
QQYGSSPWT

SEQ ID NO: 5642 - protein, 246 aa, Artificial Sequence
  Description of Artificial Sequence: Synthetic polypeptide
  XENP019835 [CTLA-4]_H0.87_L0_scFv(GKPGS)4
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5643 - protein, 118 aa, Artificial Sequence
  Description of Artificial Sequence: Synthetic polypeptide
  VH of XENP019835
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSS

SEQ ID NO: 5644 - protein, 108 aa, Artificial Sequence; identical to SEQ ID NO: 3741
  Description of Artificial Sequence: Synthetic polypeptide
  VL of XENP019835

SEQ ID NO: 5645 - protein, 5 aa, Artificial Sequence
  Description of Artificial Sequence: Synthetic peptide
  XENP019835 vhCDR1
SYTMH

SEQ ID NO: 5646 - protein, 17 aa, Artificial Sequence
  Description of Artificial Sequence: Synthetic peptide
  XENP019835 vhCDR2
FISYDGNNKYYADSVKG

SEQ ID NO: 5647 - protein, 9 aa, Artificial Sequence
  Description of Artificial Sequence: Synthetic peptide
  XENP019835 vhCDR3
TGWLGPFDY

SEQ ID NO: 5648 - protein, 12 aa, Artificial Sequence
  Description of Artificial Sequence: Synthetic peptide
  XENP019835 vlCDR1
RASQSVGSSYLA

SEQ ID NO: 5649 - protein, 7 aa, Artificial Sequence
  Description of Artificial Sequence: Synthetic peptide
  XENP019835 vlCDR2
GAFSRAT

SEQ ID NO: 5650 - protein, 9 aa, Artificial Sequence
  Description of Artificial Sequence: Synthetic peptide
  XENP019835 vlCDR3
QQYGSSPWT

SEQ ID NO: 5651 - protein, 246 aa, Artificial Sequence
  Description of Artificial Sequence: Synthetic polypeptide
  XENP019836 [CTLA-4]_H0.88_L0_scFv(GKPGS)4
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5652 - protein, 118 aa, Artificial Sequence
  Description of Artificial Sequence: Synthetic polypeptide
  VH of XENP019836
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSS

SEQ ID NO: 5653 - protein, 108 aa, Artificial Sequence; identical to SEQ ID NO: 3741
  Description of Artificial Sequence: Synthetic polypeptide
  VL of XENP019836

SEQ ID NO: 5654 - protein, 5 aa, Artificial Sequence
  Description of Artificial Sequence: Synthetic peptide
  XENP019836 vhCDR1
SYTMH

SEQ ID NO: 5655 - protein, 17 aa, Artificial Sequence
  Description of Artificial Sequence: Synthetic peptide
  XENP019836 vhCDR2
FISYDGNNKYYADSVKG

SEQ ID NO: 5656 - protein, 9 aa, Artificial Sequence
  Description of Artificial Sequence: Synthetic peptide
  XENP019836 vhCDR3
TGWLGPFDY

SEQ ID NO: 5657 - protein, 12 aa, Artificial Sequence
  Description of Artificial Sequence: Synthetic peptide
  XENP019836 vlCDR1
RASQSVGSSYLA

SEQ ID NO: 5658 - protein, 7 aa, Artificial Sequence
  Description of Artificial Sequence: Synthetic peptide
  XENP019836 vlCDR2
GAFSRAT

SEQ ID NO: 5659 - protein, 9 aa, Artificial Sequence
  Description of Artificial Sequence: Synthetic peptide
  XENP019836 vlCDR3
QQYGSSPWT

SEQ ID NO: 5660 - protein, 246 aa, Artificial Sequence
  Description of Artificial Sequence: Synthetic polypeptide
  XENP019837 [CTLA-4]_H0.89_L0_scFv(GKPGS)4
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5661 - protein, 118 aa, Artificial Sequence
  Description of Artificial Sequence: Synthetic polypeptide
  VH of XENP019837
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSS

SEQ ID NO: 5662 - protein, 108 aa, Artificial Sequence; identical to SEQ ID NO: 3741
  Description of Artificial Sequence: Synthetic polypeptide
  VL of XENP019837

SEQ ID NO: 5663 - protein, 5 aa, Artificial Sequence
  Description of Artificial Sequence: Synthetic peptide
  XENP019837 vhCDR1
SYTMH

SEQ ID NO: 5664 - protein, 17 aa, Artificial Sequence
  Description of Artificial Sequence: Synthetic peptide
  XENP019837 vhCDR2
FISYDGNNKYYADSVKG

SEQ ID NO: 5665 - protein, 9 aa, Artificial Sequence
  Description of Artificial Sequence: Synthetic peptide
  XENP019837 vhCDR3
TGWLGPFDY

SEQ ID NO: 5666 - protein, 12 aa, Artificial Sequence
  Description of Artificial Sequence: Synthetic peptide
  XENP019837 vlCDR1
RASQSVGSSYLA

SEQ ID NO: 5667 - protein, 7 aa, Artificial Sequence
  Description of Artificial Sequence: Synthetic peptide
  XENP019837 vlCDR2
GAFSRAT

SEQ ID NO: 5668 - protein, 9 aa, Artificial Sequence
  Description of Artificial Sequence: Synthetic peptide
  XENP019837 vlCDR3
QQYGSSPWT

SEQ ID NO: 5669 - protein, 246 aa, Artificial Sequence
  Description of Artificial Sequence: Synthetic polypeptide
  XENP019838 [CTLA-4]_H0.90_L0_scFv(GKPGS)4
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5670 - protein, 118 aa, Artificial Sequence
  Description of Artificial Sequence: Synthetic polypeptide
  VH of XENP019838
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSS

SEQ ID NO: 5671 - protein, 108 aa, Artificial Sequence; identical to SEQ ID NO: 3741
  Description of Artificial Sequence: Synthetic polypeptide
  VL of XENP019838

SEQ ID NO: 5672 - protein, 5 aa, Artificial Sequence
  Description of Artificial Sequence: Synthetic peptide
  XENP019838 vhCDR1
SYTMH

SEQ ID NO: 5673 - protein, 17 aa, Artificial Sequence
  Description of Artificial Sequence: Synthetic peptide
  XENP019838 vhCDR2
FISYDGNNKYYADSVKG

SEQ ID NO: 5674 - protein, 9 aa, Artificial Sequence
  Description of Artificial Sequence: Synthetic peptide
  XENP019838 vhCDR3
TGWLGPFDY

SEQ ID NO: 5675 - protein, 12 aa, Artificial Sequence
  Description of Artificial Sequence: Synthetic peptide
  XENP019838 vlCDR1
RASQSVGSSYLA

SEQ ID NO: 5676 - protein, 7 aa, Artificial Sequence
  Description of Artificial Sequence: Synthetic peptide
  XENP019838 vlCDR2
GAFSRAT

SEQ ID NO: 5677 - protein, 9 aa, Artificial Sequence
  Description of Artificial Sequence: Synthetic peptide
  XENP019838 vlCDR3
QQYGSSPWT

SEQ ID NO: 5678 - protein, 246 aa, Artificial Sequence
  Description of Artificial Sequence: Synthetic polypeptide
  XENP019839 [CTLA-4]_H0.91_L0_scFv(GKPGS)4
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5679 - protein, 118 aa, Artificial Sequence
  Description of Artificial Sequence: Synthetic polypeptide
  VH of XENP019839
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSS

SEQ ID NO: 5680 - protein, 108 aa, Artificial Sequence; identical to SEQ ID NO: 3741
  Description of Artificial Sequence: Synthetic polypeptide
  VL of XENP019839

SEQ ID NO: 5681 - protein, 5 aa, Artificial Sequence
  Description of Artificial Sequence: Synthetic peptide
  XENP019839 vhCDR1
SYTMH

SEQ ID NO: 5682 - protein, 17 aa, Artificial Sequence
  Description of Artificial Sequence: Synthetic peptide
  XENP019839 vhCDR2
FISYDGNNKYYADSVKG

SEQ ID NO: 5683 - protein, 9 aa, Artificial Sequence
  Description of Artificial Sequence: Synthetic peptide
  XENP019839 vhCDR3
TGWLGPFDY

SEQ ID NO: 5684 - protein, 12 aa, Artificial Sequence
  Description of Artificial Sequence: Synthetic peptide
  XENP019839 vlCDR1
RASQSVGSSYLA

SEQ ID NO: 5685 - protein, 7 aa, Artificial Sequence
  Description of Artificial Sequence: Synthetic peptide
  XENP019839 vlCDR2
GAFSRAT

SEQ ID NO: 5686 - protein, 9 aa, Artificial Sequence
  Description of Artificial Sequence: Synthetic peptide
  XENP019839 vlCDR3
QQYGSSPWT

SEQ ID NO: 5687 - protein, 246 aa, Artificial Sequence
  Description of Artificial Sequence: Synthetic polypeptide
  XENP019840 [CTLA-4]_H0.92_L0_scFv(GKPGS)4
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5688 - protein, 118 aa, Artificial Sequence
  Description of Artificial Sequence: Synthetic polypeptide
  VH of XENP019840
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSS

SEQ ID NO: 5689 - protein, 108 aa, Artificial Sequence; identical to SEQ ID NO: 3741
  Description of Artificial Sequence: Synthetic polypeptide
  VL of XENP019840

SEQ ID NO: 5690 - protein, 5 aa, Artificial Sequence
  Description of Artificial Sequence: Synthetic peptide
  XENP019840 vhCDR1
SYTMH

SEQ ID NO: 5691 - protein, 17 aa, Artificial Sequence
  Description of Artificial Sequence: Synthetic peptide
  XENP019840 vhCDR2
FISYDGNNKYYADSVKG

SEQ ID NO: 5692 - protein, 9 aa, Artificial Sequence
  Description of Artificial Sequence: Synthetic peptide
  XENP019840 vhCDR3
TGWLGPFDY

SEQ ID NO: 5693 - protein, 12 aa, Artificial Sequence
  Description of Artificial Sequence: Synthetic peptide
  XENP019840 vlCDR1
RASQSVGSSYLA

SEQ ID NO: 5694 - protein, 7 aa, Artificial Sequence
  Description of Artificial Sequence: Synthetic peptide
  XENP019840 vlCDR2
GAFSRAT

SEQ ID NO: 5695 - protein, 9 aa, Artificial Sequence
  Description of Artificial Sequence: Synthetic peptide
  XENP019840 vlCDR3
QQYGSSPWT

SEQ ID NO: 5696 - protein, 246 aa, Artificial Sequence
  Description of Artificial Sequence: Synthetic polypeptide
  XENP019841 [CTLA-4]_H0.93_L0_scFv(GKPGS)4
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5697 - protein, 118 aa, Artificial Sequence
  Description of Artificial Sequence: Synthetic polypeptide
  VH of XENP019841
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSS

SEQ ID NO: 5698 - protein, 108 aa, Artificial Sequence; identical to SEQ ID NO: 3741
  Description of Artificial Sequence: Synthetic polypeptide
  VL of XENP019841

SEQ ID NO: 5699 - protein, 5 aa, Artificial Sequence
  Description of Artificial Sequence: Synthetic peptide
  XENP019841 vhCDR1
SYTMH

SEQ ID NO: 5700 - protein, 17 aa, Artificial Sequence
  Description of Artificial Sequence: Synthetic peptide
  XENP019841 vhCDR2
FISYDGNNKYYADSVKG

SEQ ID NO: 5701 - protein, 9 aa, Artificial Sequence
  Description of Artificial Sequence: Synthetic peptide
  XENP019841 vhCDR3
TGWLGPFDY

SEQ ID NO: 5702 - protein, 12 aa, Artificial Sequence
  Description of Artificial Sequence: Synthetic peptide
  XENP019841 vlCDR1
RASQSVGSSYLA

SEQ ID NO: 5703 - protein, 7 aa, Artificial Sequence
  Description of Artificial Sequence: Synthetic peptide
  XENP019841 vlCDR2
GAFSRAT

SEQ ID NO: 5704 - protein, 9 aa, Artificial Sequence
  Description of Artificial Sequence: Synthetic peptide
  XENP019841 vlCDR3
QQYGSSPWT

SEQ ID NO: 5705 - protein, 246 aa, Artificial Sequence
  Description of Artificial Sequence: Synthetic polypeptide
  XENP019842 [CTLA-4]_H0.94_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5706 - protein, 118 aa, Artificial Sequence
  Description of Artificial Sequence: Synthetic polypeptide
  VH of XENP019842
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSS

SEQ ID NO: 5707 - protein, 108 aa, Artificial Sequence; identical to SEQ ID NO: 3741
  Description of Artificial Sequence: Synthetic polypeptide
  VL of XENP019842

SEQ ID NO: 5708 - protein, 5 aa, Artificial Sequence
  Description of Artificial Sequence: Synthetic peptide
  XENP019842 vhCDR1
SYTMH

SEQ ID NO: 5709 - protein, 17 aa, Artificial Sequence
  Description of Artificial Sequence: Synthetic peptide
  XENP019842 vhCDR2
FISYDGNNKYYADSVKG

SEQ ID NO: 5710 - protein, 9 aa, Artificial Sequence
  Description of Artificial Sequence: Synthetic peptide
  XENP019842 vhCDR3
TGWLGPFDY

SEQ ID NO: 5711 - protein, 12 aa, Artificial Sequence
  Description of Artificial Sequence: Synthetic peptide
  XENP019842 vlCDR1
RASQSVGSSYLA

SEQ ID NO: 5712 - protein, 7 aa, Artificial Sequence
  Description of Artificial Sequence: Synthetic peptide
  XENP019842 vlCDR2
GAFSRAT

SEQ ID NO: 5713 - protein, 9 aa, Artificial Sequence
  Description of Artificial Sequence: Synthetic peptide
  XENP019842 vlCDR3
QQYGSSPWT

SEQ ID NO: 5714 - protein, 246 aa, Artificial Sequence
  Description of Artificial Sequence: Synthetic polypeptide
  XENP019843 [CTLA-4]_H0.95_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5715 - protein, 118 aa, Artificial Sequence
  Description of Artificial Sequence: Synthetic polypeptide
  VH of XENP019843
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSS

SEQ ID NO: 5716 - protein, 108 aa, Artificial Sequence; identical to SEQ ID NO: 3741
  Description of Artificial Sequence: Synthetic polypeptide
  VL of XENP019843

SEQ ID NO: 5717 - protein, 5 aa, Artificial Sequence
  Description of Artificial Sequence: Synthetic peptide
  XENP019843 vhCDR1
SYTMH

SEQ ID NO: 5718 - protein, 17 aa, Artificial Sequence
  Description of Artificial Sequence: Synthetic peptide
  XENP019843 vhCDR2
FISYDGNNKYYADSVKG

SEQ ID NO: 5719 - protein, 9 aa, Artificial Sequence
  Description of Artificial Sequence: Synthetic peptide
  XENP019843 vhCDR3
TGWLGPFDY

SEQ ID NO: 5720 - protein, 12 aa, Artificial Sequence
  Description of Artificial Sequence: Synthetic peptide
  XENP019843 vlCDR1
RASQSVGSSYLA

SEQ ID NO: 5721 - protein, 7 aa, Artificial Sequence
  Description of Artificial Sequence: Synthetic peptide
  XENP019843 vlCDR2
GAFSRAT

SEQ ID NO: 5722 - protein, 9 aa, Artificial Sequence
  Description of Artificial Sequence: Synthetic peptide
  XENP019843 vlCDR3
QQYGSSPWT

SEQ ID NO: 5723 - protein, 246 aa, Artificial Sequence
  Description of Artificial Sequence: Synthetic polypeptide
  XENP019844 [CTLA-4]_H0.96_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5724 - protein, 118 aa, Artificial Sequence
  Description of Artificial Sequence: Synthetic polypeptide
  VH of XENP019844
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSS

SEQ ID NO: 5725 - protein, 108 aa, Artificial Sequence; identical to SEQ ID NO: 3741
  Description of Artificial Sequence: Synthetic polypeptide
  VL of XENP019844

SEQ ID NO: 5726 - protein, 5 aa, Artificial Sequence
  Description of Artificial Sequence: Synthetic peptide
  XENP019844 vhCDR1
SYTMH

SEQ ID NO: 5727 - protein, 17 aa, Artificial Sequence
  Description of Artificial Sequence: Synthetic peptide
  XENP019844 vhCDR2
FISYDGNNKYYADSVKG

SEQ ID NO: 5728 - protein, 9 aa, Artificial Sequence
  Description of Artificial Sequence: Synthetic peptide
  XENP019844 vhCDR3
TGWLGPFDY

SEQ ID NO: 5729 - protein, 12 aa, Artificial Sequence
  Description of Artificial Sequence: Synthetic peptide
  XENP019844 vlCDR1
RASQSVGSSYLA

SEQ ID NO: 5730 - protein, 7 aa, Artificial Sequence
  Description of Artificial Sequence: Synthetic peptide
  XENP019844 vlCDR2
GAFSRAT

SEQ ID NO: 5731 - protein, 9 aa, Artificial Sequence
  Description of Artificial Sequence: Synthetic peptide
  XENP019844 vlCDR3
QQYGSSPWT

SEQ ID NO: 5732 - protein, 246 aa, Artificial Sequence
  Description of Artificial Sequence: Synthetic polypeptide
  XENP019845 [CTLA-4]_H0.97_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5733 - protein, 118 aa, Artificial Sequence
  Description of Artificial Sequence: Synthetic polypeptide
  VH of XENP019845
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSS

SEQ ID NO: 5734 - protein, 108 aa, Artificial Sequence; identical to SEQ ID NO: 3741
  Description of Artificial Sequence: Synthetic polypeptide
  VL of XENP019845

SEQ ID NO: 5735 - protein, 5 aa, Artificial Sequence
  Description of Artificial Sequence: Synthetic peptide
  XENP019845 vhCDR1
SYTMH

SEQ ID NO: 5736 - protein, 17 aa, Artificial Sequence
  Description of Artificial Sequence: Synthetic peptide
  XENP019845 vhCDR2
FISYDGNNKYYADSVKG

SEQ ID NO: 5737 - protein, 9 aa, Artificial Sequence
  Description of Artificial Sequence: Synthetic peptide
  XENP019845 vhCDR3
TGWLGPFDY

SEQ ID NO: 5738 - protein, 12 aa, Artificial Sequence
  Description of Artificial Sequence: Synthetic peptide
  XENP019845 vlCDR1
RASQSVGSSYLA

SEQ ID NO: 5739 - protein, 7 aa, Artificial Sequence
  Description of Artificial Sequence: Synthetic peptide
  XENP019845 vlCDR2
GAFSRAT

SEQ ID NO: 5740 - protein, 9 aa, Artificial Sequence
  Description of Artificial Sequence: Synthetic peptide
  XENP019845 vlCDR3
QQYGSSPWT

SEQ ID NO: 5741 - protein, 246 aa, Artificial Sequence
  Description of Artificial Sequence: Synthetic polypeptide
  XENP019846 [CTLA-4]_H0.98_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5742 - protein, 118 aa, Artificial Sequence
  Description of Artificial Sequence: Synthetic polypeptide
  VH of XENP019846
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSS

SEQ ID NO: 5743 - protein, 108 aa, Artificial Sequence; identical to SEQ ID NO: 3741
  Description of Artificial Sequence: Synthetic polypeptide
  VL of XENP019846

SEQ ID NO: 5744 - protein, 5 aa, Artificial Sequence
  Description of Artificial Sequence: Synthetic peptide
  XENP019846 vhCDR1
SYTMH

SEQ ID NO: 5745 - protein, 17 aa, Artificial Sequence
  Description of Artificial Sequence: Synthetic peptide
  XENP019846 vhCDR2
FISYDGNNKYYADSVKG

SEQ ID NO: 5746 - protein, 9 aa, Artificial Sequence
  Description of Artificial Sequence: Synthetic peptide
  XENP019846 vhCDR3
TGWLGPFDY

SEQ ID NO: 5747 - protein, 12 aa, Artificial Sequence
  Description of Artificial Sequence: Synthetic peptide
  XENP019846 vlCDR1
RASQSVGSSYLA

SEQ ID NO: 5748 - protein, 7 aa, Artificial Sequence
  Description of Artificial Sequence: Synthetic peptide
  XENP019846 vlCDR2
GAFSRAT

SEQ ID NO: 5749 - protein, 9 aa, Artificial Sequence
  Description of Artificial Sequence: Synthetic peptide
  XENP019846 vlCDR3
QQYGSSPWT

SEQ ID NO: 5750 - protein, 246 aa, Artificial Sequence
  Description of Artificial Sequence: Synthetic polypeptide
  XENP019847 [CTLA-4]_H0.99_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5751 - protein, 118 aa, Artificial Sequence
  Description of Artificial Sequence: Synthetic polypeptide
  VH of XENP019847
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSS

SEQ ID NO: 5752 - protein, 108 aa, Artificial Sequence; identical to SEQ ID NO: 3741
  Description of Artificial Sequence: Synthetic polypeptide
  VL of XENP019847

SEQ ID NO: 5753 - protein, 5 aa, Artificial Sequence
  Description of Artificial Sequence: Synthetic peptide
  XENP019847 vhCDR1
SYTMH

SEQ ID NO: 5754 - protein, 17 aa, Artificial Sequence
  Description of Artificial Sequence: Synthetic peptide
  XENP019847 vhCDR2
FISYDGNNKYYADSVKG

SEQ ID NO: 5755 - protein, 9 aa, Artificial Sequence
  Description of Artificial Sequence: Synthetic peptide
  XENP019847 vhCDR3
TGWLGPFDY

SEQ ID NO: 5756 - protein, 12 aa, Artificial Sequence
  Description of Artificial Sequence: Synthetic peptide
  XENP019847 vlCDR1
RASQSVGSSYLA

SEQ ID NO: 5757 - protein, 7 aa, Artificial Sequence
  Description of Artificial Sequence: Synthetic peptide
  XENP019847 vlCDR2
GAFSRAT

SEQ ID NO: 5758 - protein, 9 aa, Artificial Sequence
  Description of Artificial Sequence: Synthetic peptide
  XENP019847 vlCDR3
QQYGSSPWT

SEQ ID NO: 5759 - protein, 246 aa, Artificial Sequence
  Description of Artificial Sequence: Synthetic polypeptide
  XENP019848 [CTLA-4]_H0.100_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5760 - protein, 118 aa, Artificial Sequence
  Description of Artificial Sequence: Synthetic polypeptide
  VH of XENP019848
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSS

SEQ ID NO: 5761 - protein, 108 aa, Artificial Sequence; identical to SEQ ID NO: 3741
  Description of Artificial Sequence: Synthetic polypeptide
  VL of XENP019848

SEQ ID NO: 5762 - protein, 5 aa, Artificial Sequence
  Description of Artificial Sequence: Synthetic peptide
  XENP019848 vhCDR1
SYTMH

SEQ ID NO: 5763 - protein, 17 aa, Artificial Sequence
  Description of Artificial Sequence: Synthetic peptide
  XENP019848 vhCDR2
FISYDGNNKYYADSVKG

SEQ ID NO: 5764 - protein, 9 aa, Artificial Sequence
  Description of Artificial Sequence: Synthetic peptide
  XENP019848 vhCDR3
TGWLGPFDY

SEQ ID NO: 5765 - protein, 12 aa, Artificial Sequence
  Description of Artificial Sequence: Synthetic peptide
  XENP019848 vlCDR1
RASQSVGSSYLA

SEQ ID NO: 5766 - protein, 7 aa, Artificial Sequence
  Description of Artificial Sequence: Synthetic peptide
  XENP019848 vlCDR2
GAFSRAT

SEQ ID NO: 5767 - protein, 9 aa, Artificial Sequence
  Description of Artificial Sequence: Synthetic peptide
  XENP019848 vlCDR3
QQYGSSPWT

SEQ ID NO: 5768 - protein, 246 aa, Artificial Sequence
  Description of Artificial Sequence: Synthetic polypeptide
  XENP019849 [CTLA-4]_H0.101_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5769 - protein, 118 aa, Artificial Sequence
  Description of Artificial Sequence: Synthetic polypeptide
  VH of XENP019849
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSS

SEQ ID NO: 5770 - protein, 108 aa, Artificial Sequence; identical to SEQ ID NO: 3741
  Description of Artificial Sequence: Synthetic polypeptide
  VL of XENP019849

SEQ ID NO: 5771 - protein, 5 aa, Artificial Sequence
  Description of Artificial Sequence: Synthetic peptide
  XENP019849 vhCDR1
SYTMH

SEQ ID NO: 5772 - protein, 17 aa, Artificial Sequence
  Description of Artificial Sequence: Synthetic peptide
  XENP019849 vhCDR2
FISYDGNNKYYADSVKG

SEQ ID NO: 5773 - protein, 9 aa, Artificial Sequence
  Description of Artificial Sequence: Synthetic peptide
  XENP019849 vhCDR3
TGWLGPFDY

SEQ ID NO: 5774 - protein, 12 aa, Artificial Sequence
  Description of Artificial Sequence: Synthetic peptide
  XENP019849 vlCDR1
RASQSVGSSYLA

SEQ ID NO: 5775 - protein, 7 aa, Artificial Sequence
  Description of Artificial Sequence: Synthetic peptide
  XENP019849 vlCDR2
GAFSRAT

SEQ ID NO: 5776 - protein, 9 aa, Artificial Sequence
  Description of Artificial Sequence: Synthetic peptide
  XENP019849 vlCDR3
QQYGSSPWT

SEQ ID NO: 5777 - protein, 246 aa, Artificial Sequence
  Description of Artificial Sequence: Synthetic polypeptide
  XENP019850 [CTLA-4]_H0.102_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5778 - protein, 118 aa, Artificial Sequence
  Description of Artificial Sequence: Synthetic polypeptide
  VH of XENP019850
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSS

SEQ ID NO: 5779 - protein, 108 aa, Artificial Sequence; identical to SEQ ID NO: 3741
  Description of Artificial Sequence: Synthetic polypeptide
  VL of XENP019850

SEQ ID NO: 5780 - protein, 5 aa, Artificial Sequence
  Description of Artificial Sequence: Synthetic peptide
  XENP019850 vhCDR1
SYTMH

SEQ ID NO: 5781 - protein, 17 aa, Artificial Sequence
  Description of Artificial Sequence: Synthetic peptide
  XENP019850 vhCDR2
FISYDGNNKYYADSVKG

SEQ ID NO: 5782 - protein, 9 aa, Artificial Sequence
  Description of Artificial Sequence: Synthetic peptide
  XENP019850 vhCDR3
AGWLGPFDY

SEQ ID NO: 5783 - protein, 12 aa, Artificial Sequence
  Description of Artificial Sequence: Synthetic peptide
  XENP019850 vlCDR1
RASQSVGSSYLA

SEQ ID NO: 5784 - protein, 7 aa, Artificial Sequence
  Description of Artificial Sequence: Synthetic peptide
  XENP019850 vlCDR2
GAFSRAT

SEQ ID NO: 5785 - protein, 9 aa, Artificial Sequence
  Description of Artificial Sequence: Synthetic peptide
  XENP019850 vlCDR3
QQYGSSPWT

SEQ ID NO: 5786 - protein, 246 aa, Artificial Sequence
  Description of Artificial Sequence: Synthetic polypeptide
  XENP019851 [CTLA-4]_H0.103_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5787 - protein, 118 aa, Artificial Sequence
  Description of Artificial Sequence: Synthetic polypeptide
  VH of XENP019851
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSS

SEQ ID NO: 5788 - protein, 108 aa, Artificial Sequence; identical to SEQ ID NO: 3741
  Description of Artificial Sequence: Synthetic polypeptide
  VL of XENP019851

SEQ ID NO: 5789 - protein, 5 aa, Artificial Sequence
  Description of Artificial Sequence: Synthetic peptide
  XENP019851 vhCDR1
SYTMH

SEQ ID NO: 5790 - protein, 17 aa, Artificial Sequence
  Description of Artificial Sequence: Synthetic peptide
  XENP019851 vhCDR2
FISYDGNNKYYADSVKG

SEQ ID NO: 5791 - protein, 9 aa, Artificial Sequence
  Description of Artificial Sequence: Synthetic peptide
  XENP019851 vhCDR3
GGWLGPFDY

SEQ ID NO: 5792 - protein, 12 aa, Artificial Sequence
  Description of Artificial Sequence: Synthetic peptide
  XENP019851 vlCDR1
RASQSVGSSYLA

SEQ ID NO: 5793 - protein, 7 aa, Artificial Sequence
  Description of Artificial Sequence: Synthetic peptide
  XENP019851 vlCDR2
GAFSRAT

SEQ ID NO: 5794 - protein, 9 aa, Artificial Sequence
  Description of Artificial Sequence: Synthetic peptide
  XENP019851 vlCDR3
QQYGSSPWT

SEQ ID NO: 5795 - protein, 246 aa, Artificial Sequence
  Description of Artificial Sequence: Synthetic polypeptide
  XENP019852 [CTLA-4]_H0.104_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5796 - protein, 118 aa, Artificial Sequence
  Description of Artificial Sequence: Synthetic polypeptide
  VH of XENP019852
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSS

SEQ ID NO: 5797 - protein, 108 aa, Artificial Sequence; identical to SEQ ID NO: 3741
  Description of Artificial Sequence: Synthetic polypeptide
  VL of XENP019852

SEQ ID NO: 5798 - protein, 5 aa, Artificial Sequence
  Description of Artificial Sequence: Synthetic peptide
  XENP019852 vhCDR1
SYTMH

SEQ ID NO: 5799 - protein, 17 aa, Artificial Sequence
  Description of Artificial Sequence: Synthetic peptide
  XENP019852 vhCDR2
FISYDGNNKYYADSVKG

SEQ ID NO: 5800 - protein, 9 aa, Artificial Sequence
  Description of Artificial Sequence: Synthetic peptide
  XENP019852 vhCDR3
DGWLGPFDY

SEQ ID NO: 5801 - protein, 12 aa, Artificial Sequence
  Description of Artificial Sequence: Synthetic peptide
  XENP019852 vlCDR1
RASQSVGSSYLA

SEQ ID NO: 5802 - protein, 7 aa, Artificial Sequence
  Description of Artificial Sequence: Synthetic peptide
  XENP019852 vlCDR2
GAFSRAT

SEQ ID NO: 5803 - protein, 9 aa, Artificial Sequence
  Description of Artificial Sequence: Synthetic peptide
  XENP019852 vlCDR3
QQYGSSPWT

SEQ ID NO: 5804 - protein, 246 aa, Artificial Sequence
  Description of Artificial Sequence: Synthetic polypeptide
  XENP019853 [CTLA-4]_H0.105_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5805 - protein, 118 aa, Artificial Sequence
  Description of Artificial Sequence: Synthetic polypeptide
  VH of XENP019853
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSS

SEQ ID NO: 5806 - protein, 108 aa, Artificial Sequence; identical to SEQ ID NO: 3741
  Description of Artificial Sequence: Synthetic polypeptide
  VL of XENP019853

SEQ ID NO: 5807 - protein, 5 aa, Artificial Sequence
  Description of Artificial Sequence: Synthetic peptide
  XENP019853 vhCDR1
SYTMH

SEQ ID NO: 5808 - protein, 17 aa, Artificial Sequence
  Description of Artificial Sequence: Synthetic peptide
  XENP019853 vhCDR2
FISYDGNNKYYADSVKG

SEQ ID NO: 5809 - protein, 9 aa, Artificial Sequence
  Description of Artificial Sequence: Synthetic peptide
  XENP019853 vhCDR3
SGWLGPFDY

SEQ ID NO: 5810 - protein, 12 aa, Artificial Sequence
  Description of Artificial Sequence: Synthetic peptide
  XENP019853 vlCDR1
RASQSVGSSYLA

SEQ ID NO: 5811 - protein, 7 aa, Artificial Sequence
  Description of Artificial Sequence: Synthetic peptide
  XENP019853 vlCDR2
GAFSRAT

SEQ ID NO: 5812 - protein, 9 aa, Artificial Sequence
  Description of Artificial Sequence: Synthetic peptide
  XENP019853 vlCDR3
QQYGSSPWT

SEQ ID NO: 5813 - protein, 246 aa, Artificial Sequence
  Description of Artificial Sequence: Synthetic polypeptide
  XENP019854 [CTLA-4]_H0.106_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5814 - protein, 118 aa, Artificial Sequence
  Description of Artificial Sequence: Synthetic polypeptide
  VH of XENP019854
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSS

SEQ ID NO: 5815 - protein, 108 aa, Artificial Sequence; identical to SEQ ID NO: 3741
  Description of Artificial Sequence: Synthetic polypeptide
  VL of XENP019854

SEQ ID NO: 5816 - protein, 5 aa, Artificial Sequence
  Description of Artificial Sequence: Synthetic peptide
  XENP019854 vhCDR1
SYTMH

SEQ ID NO: 5817 - protein, 17 aa, Artificial Sequence
  Description of Artificial Sequence: Synthetic peptide
  XENP019854 vhCDR2
FISYDGNNKYYADSVKG

SEQ ID NO: 5818 - protein, 9 aa, Artificial Sequence
  Description of Artificial Sequence: Synthetic peptide
  XENP019854 vhCDR3
VGWLGPFDY

SEQ ID NO: 5819 - protein, 12 aa, Artificial Sequence
  Description of Artificial Sequence: Synthetic peptide
  XENP019854 vlCDR1
RASQSVGSSYLA

SEQ ID NO: 5820 - protein, 7 aa, Artificial Sequence
  Description of Artificial Sequence: Synthetic peptide
  XENP019854 vlCDR2
GAFSRAT

SEQ ID NO: 5821 - protein, 9 aa, Artificial Sequence
  Description of Artificial Sequence: Synthetic peptide
  XENP019854 vlCDR3
QQYGSSPWT

SEQ ID NO: 5822 - protein, 246 aa, Artificial Sequence
  Description of Artificial Sequence: Synthetic polypeptide
  XENP019855 [CTLA-4]_H0.107_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5823 - protein, 118 aa, Artificial Sequence
  Description of Artificial Sequence: Synthetic polypeptide
  VH of XENP019855
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSS

SEQ ID NO: 5824 - protein, 108 aa, Artificial Sequence; identical to SEQ ID NO: 3741
  Description of Artificial Sequence: Synthetic polypeptide
  VL of XENP019855

SEQ ID NO: 5825 - protein, 5 aa, Artificial Sequence
  Description of Artificial Sequence: Synthetic peptide
  XENP019855 vhCDR1
SYTMH

SEQ ID NO: 5826 - protein, 17 aa, Artificial Sequence
  Description of Artificial Sequence: Synthetic peptide
  XENP019855 vhCDR2
FISYDGNNKYYADSVKG

SEQ ID NO: 5827 - protein, 9 aa, Artificial Sequence
  Description of Artificial Sequence: Synthetic peptide
  XENP019855 vhCDR3
YGWLGPFDY

SEQ ID NO: 5828 - protein, 12 aa, Artificial Sequence
  Description of Artificial Sequence: Synthetic peptide
  XENP019855 vlCDR1
RASQSVGSSYLA

SEQ ID NO: 5829 - protein, 7 aa, Artificial Sequence
  Description of Artificial Sequence: Synthetic peptide
  XENP019855 vlCDR2
GAFSRAT

SEQ ID NO: 5830 - protein, 9 aa, Artificial Sequence
  Description of Artificial Sequence: Synthetic peptide
  XENP019855 vlCDR3
QQYGSSPWT

SEQ ID NO: 5831 - protein, 246 aa, Artificial Sequence
  Description of Artificial Sequence: Synthetic polypeptide
  XENP019856 [CTLA-4]_H0.108_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5832 - protein, 118 aa, Artificial Sequence
  Description of Artificial Sequence: Synthetic polypeptide
  VH of XENP019856
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSS

SEQ ID NO: 5833 - protein, 108 aa, Artificial Sequence; identical to SEQ ID NO: 3741
  Description of Artificial Sequence: Synthetic polypeptide
  VL of XENP019856

SEQ ID NO: 5834 - protein, 5 aa, Artificial Sequence
  Description of Artificial Sequence: Synthetic peptide
  XENP019856 vhCDR1
SYTMH

SEQ ID NO: 5835 - protein, 17 aa, Artificial Sequence
  Description of Artificial Sequence: Synthetic peptide
  XENP019856 vhCDR2
FISYDGNNKYYADSVKG

SEQ ID NO: 5836 - protein, 9 aa, Artificial Sequence
  Description of Artificial Sequence: Synthetic peptide
  XENP019856 vhCDR3
TAWLGPFDY

SEQ ID NO: 5837 - protein, 12 aa, Artificial Sequence
  Description of Artificial Sequence: Synthetic peptide
  XENP019856 vlCDR1
RASQSVGSSYLA

SEQ ID NO: 5838 - protein, 7 aa, Artificial Sequence
  Description of Artificial Sequence: Synthetic peptide
  XENP019856 vlCDR2
GAFSRAT

SEQ ID NO: 5839 - protein, 9 aa, Artificial Sequence
  Description of Artificial Sequence: Synthetic peptide
  XENP019856 vlCDR3
QQYGSSPWT

SEQ ID NO: 5840 - protein, 246 aa, Artificial Sequence
  Description of Artificial Sequence: Synthetic polypeptide
  XENP019857 [CTLA-4]_H0.109_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5841 - protein, 118 aa, Artificial Sequence
  Description of Artificial Sequence: Synthetic polypeptide
  VH of XENP019857
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSS

SEQ ID NO: 5842 - protein, 108 aa, Artificial Sequence; identical to SEQ ID NO: 3741
  Description of Artificial Sequence: Synthetic polypeptide
  VL of XENP019857

SEQ ID NO: 5843 - protein, 5 aa, Artificial Sequence
  Description of Artificial Sequence: Synthetic peptide
  XENP019857 vhCDR1
SYTMH

SEQ ID NO: 5844 - protein, 17 aa, Artificial Sequence
  Description of Artificial Sequence: Synthetic peptide
  XENP019857 vhCDR2
FISYDGNNKYYADSVKG

SEQ ID NO: 5845 - protein, 9 aa, Artificial Sequence
  Description of Artificial Sequence: Synthetic peptide
  XENP019857 vhCDR3
TSWLGPFDY

SEQ ID NO: 5846 - protein, 12 aa, Artificial Sequence
  Description of Artificial Sequence: Synthetic peptide
  XENP019857 vlCDR1
RASQSVGSSYLA

SEQ ID NO: 5847 - protein, 7 aa, Artificial Sequence
  Description of Artificial Sequence: Synthetic peptide
  XENP019857 vlCDR2
GAFSRAT

SEQ ID NO: 5848 - protein, 9 aa, Artificial Sequence
  Description of Artificial Sequence: Synthetic peptide
  XENP019857 vlCDR3
QQYGSSPWT

SEQ ID NO: 5849 - protein, 246 aa, Artificial Sequence
  Description of Artificial Sequence: Synthetic polypeptide
  XENP019858 [CTLA-4]_H0.110_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5850 - protein, 118 aa, Artificial Sequence
  Description of Artificial Sequence: Synthetic polypeptide
  VH of XENP019858
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSS

SEQ ID NO: 5851 - protein, 108 aa, Artificial Sequence; identical to SEQ ID NO: 3741
  Description of Artificial Sequence: Synthetic polypeptide
  VL of XENP019858

SEQ ID NO: 5852 - protein, 5 aa, Artificial Sequence
  Description of Artificial Sequence: Synthetic peptide
  XENP019858 vhCDR1
SYTMH

SEQ ID NO: 5853 - protein, 17 aa, Artificial Sequence
  Description of Artificial Sequence: Synthetic peptide
  XENP019858 vhCDR2
FISYDGNNKYYADSVKG

SEQ ID NO: 5854 - protein, 9 aa, Artificial Sequence
  Description of Artificial Sequence: Synthetic peptide
  XENP019858 vhCDR3
TTWLGPFDY

SEQ ID NO: 5855 - protein, 12 aa, Artificial Sequence
  Description of Artificial Sequence: Synthetic peptide
  XENP019858 vlCDR1
RASQSVGSSYLA

SEQ ID NO: 5856 - protein, 7 aa, Artificial Sequence
  Description of Artificial Sequence: Synthetic peptide
  XENP019858 vlCDR2
GAFSRAT

SEQ ID NO: 5857 - protein, 9 aa, Artificial Sequence
  Description of Artificial Sequence: Synthetic peptide
  XENP019858 vlCDR3
QQYGSSPWT

SEQ ID NO: 5858 - protein, 246 aa, Artificial Sequence
  Description of Artificial Sequence: Synthetic polypeptide
  XENP019859 [CTLA-4]_H0.111_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5859 - protein, 118 aa, Artificial Sequence
  Description of Artificial Sequence: Synthetic polypeptide
  VH of XENP019859
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSS

SEQ ID NO: 5860 - protein, 108 aa, Artificial Sequence; identical to SEQ ID NO: 3741
  Description of Artificial Sequence: Synthetic polypeptide
  VL of XENP019859

SEQ ID NO: 5861 - protein, 5 aa, Artificial Sequence
  Description of Artificial Sequence: Synthetic peptide
  XENP019859 vhCDR1
SYTMH

SEQ ID NO: 5862 - protein, 17 aa, Artificial Sequence
  Description of Artificial Sequence: Synthetic peptide
  XENP019859 vhCDR2
FISYDGNNKYYADSVKG

SEQ ID NO: 5863 - protein, 9 aa, Artificial Sequence
  Description of Artificial Sequence: Synthetic peptide
  XENP019859 vhCDR3
TGFLGPFDY

SEQ ID NO: 5864 - protein, 12 aa, Artificial Sequence
  Description of Artificial Sequence: Synthetic peptide
  XENP019859 vlCDR1
RASQSVGSSYLA

SEQ ID NO: 5865 - protein, 7 aa, Artificial Sequence
  Description of Artificial Sequence: Synthetic peptide
  XENP019859 vlCDR2
GAFSRAT

SEQ ID NO: 5866 - protein, 9 aa, Artificial Sequence
  Description of Artificial Sequence: Synthetic peptide
  XENP019859 vlCDR3
QQYGSSPWT

SEQ ID NO: 5867 - protein, 246 aa, Artificial Sequence
  Description of Artificial Sequence: Synthetic polypeptide
  XENP019860 [CTLA-4]_H0.112_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5868 - protein, 118 aa, Artificial Sequence
  Description of Artificial Sequence: Synthetic polypeptide
  VH of XENP019860
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSS

SEQ ID NO: 5869 - protein, 108 aa, Artificial Sequence; identical to SEQ ID NO: 3741
  Description of Artificial Sequence: Synthetic polypeptide
  VL of XENP019860

SEQ ID NO: 5870 - protein, 5 aa, Artificial Sequence
  Description of Artificial Sequence: Synthetic peptide
  XENP019860 vhCDR1
SYTMH

SEQ ID NO: 5871 - protein, 17 aa, Artificial Sequence
  Description of Artificial Sequence: Synthetic peptide
  XENP019860 vhCDR2
FISYDGNNKYYADSVKG

SEQ ID NO: 5872 - protein, 9 aa, Artificial Sequence
  Description of Artificial Sequence: Synthetic peptide
  XENP019860 vhCDR3
TGGLGPFDY

SEQ ID NO: 5873 - protein, 12 aa, Artificial Sequence
  Description of Artificial Sequence: Synthetic peptide
  XENP019860 vlCDR1
RASQSVGSSYLA

SEQ ID NO: 5874 - protein, 7 aa, Artificial Sequence
  Description of Artificial Sequence: Synthetic peptide
  XENP019860 vlCDR2
GAFSRAT

SEQ ID NO: 5875 - protein, 9 aa, Artificial Sequence
  Description of Artificial Sequence: Synthetic peptide
  XENP019860 vlCDR3
QQYGSSPWT

SEQ ID NO: 5876 - protein, 246 aa, Artificial Sequence
  Description of Artificial Sequence: Synthetic polypeptide
  XENP019861 [CTLA-4]_H0.113_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5877 - protein, 118 aa, Artificial Sequence
  Description of Artificial Sequence: Synthetic polypeptide
  VH of XENP019861
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSS

SEQ ID NO: 5878 - protein, 108 aa, Artificial Sequence; identical to SEQ ID NO: 3741
  Description of Artificial Sequence: Synthetic polypeptide
  VL of XENP019861

SEQ ID NO: 5879 - protein, 5 aa, Artificial Sequence
  Description of Artificial Sequence: Synthetic peptide
  XENP019861 vhCDR1
SYTMH

SEQ ID NO: 5880 - protein, 17 aa, Artificial Sequence
  Description of Artificial Sequence: Synthetic peptide
  XENP019861 vhCDR2
FISYDGNNKYYADSVKG

SEQ ID NO: 5881 - protein, 9 aa, Artificial Sequence
  Description of Artificial Sequence: Synthetic peptide
  XENP019861 vhCDR3
TGHLGPFDY

SEQ ID NO: 5882 - protein, 12 aa, Artificial Sequence
  Description of Artificial Sequence: Synthetic peptide
  XENP019861 vlCDR1
RASQSVGSSYLA

SEQ ID NO: 5883 - protein, 7 aa, Artificial Sequence
  Description of Artificial Sequence: Synthetic peptide
  XENP019861 vlCDR2
GAFSRAT

SEQ ID NO: 5884 - protein, 9 aa, Artificial Sequence
  Description of Artificial Sequence: Synthetic peptide
  XENP019861 vlCDR3
QQYGSSPWT

SEQ ID NO: 5885 - protein, 246 aa, Artificial Sequence
  Description of Artificial Sequence: Synthetic polypeptide
  XENP019862 [CTLA-4]_H0.114_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5886 - protein, 118 aa, Artificial Sequence
  Description of Artificial Sequence: Synthetic polypeptide
  VH of XENP019862
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSS

SEQ ID NO: 5887 - protein, 108 aa, Artificial Sequence; identical to SEQ ID NO: 3741
  Description of Artificial Sequence: Synthetic polypeptide
  VL of XENP019862

SEQ ID NO: 5888 - protein, 5 aa, Artificial Sequence
  Description of Artificial Sequence: Synthetic peptide
  XENP019862 vhCDR1
SYTMH

SEQ ID NO: 5889 - protein, 17 aa, Artificial Sequence
  Description of Artificial Sequence: Synthetic peptide
  XENP019862 vhCDR2
FISYDGNNKYYADSVKG

SEQ ID NO: 5890 - protein, 9 aa, Artificial Sequence
  Description of Artificial Sequence: Synthetic peptide
  XENP019862 vhCDR3
TGLLGPFDY

SEQ ID NO: 5891 - protein, 12 aa, Artificial Sequence
  Description of Artificial Sequence: Synthetic peptide
  XENP019862 vlCDR1
RASQSVGSSYLA

SEQ ID NO: 5892 - protein, 7 aa, Artificial Sequence
  Description of Artificial Sequence: Synthetic peptide
  XENP019862 vlCDR2
GAFSRAT

SEQ ID NO: 5893 - protein, 9 aa, Artificial Sequence
  Description of Artificial Sequence: Synthetic peptide
  XENP019862 vlCDR3
QQYGSSPWT

SEQ ID NO: 5894 - protein, 246 aa, Artificial Sequence
  Description of Artificial Sequence: Synthetic polypeptide
  XENP019863 [CTLA-4]_H0.115_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5895 - protein, 118 aa, Artificial Sequence
  Description of Artificial Sequence: Synthetic polypeptide
  VH of XENP019863
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSS

SEQ ID NO: 5896 - protein, 108 aa, Artificial Sequence; identical to SEQ ID NO: 3741
  Description of Artificial Sequence: Synthetic polypeptide
  VL of XENP019863

SEQ ID NO: 5897 - protein, 5 aa, Artificial Sequence
  Description of Artificial Sequence: Synthetic peptide
  XENP019863 vhCDR1
SYTMH

SEQ ID NO: 5898 - protein, 17 aa, Artificial Sequence
  Description of Artificial Sequence: Synthetic peptide
  XENP019863 vhCDR2
FISYDGNNKYYADSVKG

SEQ ID NO: 5899 - protein, 9 aa, Artificial Sequence
  Description of Artificial Sequence: Synthetic peptide
  XENP019863 vhCDR3
TGYLGPFDY

SEQ ID NO: 5900 - protein, 12 aa, Artificial Sequence
  Description of Artificial Sequence: Synthetic peptide
  XENP019863 vlCDR1
RASQSVGSSYLA

SEQ ID NO: 5901 - protein, 7 aa, Artificial Sequence
  Description of Artificial Sequence: Synthetic peptide
  XENP019863 vlCDR2
GAFSRAT

SEQ ID NO: 5902 - protein, 9 aa, Artificial Sequence
  Description of Artificial Sequence: Synthetic peptide
  XENP019863 vlCDR3
QQYGSSPWT

SEQ ID NO: 5903 - protein, 246 aa, Artificial Sequence
  Description of Artificial Sequence: Synthetic polypeptide
  XENP019864 [CTLA-4]_H0.116_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5904 - protein, 118 aa, Artificial Sequence
  Description of Artificial Sequence: Synthetic polypeptide
  VH of XENP019864
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSS

SEQ ID NO: 5905 - protein, 108 aa, Artificial Sequence; identical to SEQ ID NO: 3741
  Description of Artificial Sequence: Synthetic polypeptide
  VL of XENP019864

SEQ ID NO: 5906 - protein, 5 aa, Artificial Sequence
  Description of Artificial Sequence: Synthetic peptide
  XENP019864 vhCDR1
SYTMH

SEQ ID NO: 5907 - protein, 17 aa, Artificial Sequence
  Description of Artificial Sequence: Synthetic peptide
  XENP019864 vhCDR2
FISYDGNNKYYADSVKG

SEQ ID NO: 5908 - protein, 9 aa, Artificial Sequence
  Description of Artificial Sequence: Synthetic peptide
  XENP019864 vhCDR3
TGWDGPFDY

SEQ ID NO: 5909 - protein, 12 aa, Artificial Sequence
  Description of Artificial Sequence: Synthetic peptide
  XENP019864 vlCDR1
RASQSVGSSYLA

SEQ ID NO: 5910 - protein, 7 aa, Artificial Sequence
  Description of Artificial Sequence: Synthetic peptide
  XENP019864 vlCDR2
GAFSRAT

SEQ ID NO: 5911 - protein, 9 aa, Artificial Sequence
  Description of Artificial Sequence: Synthetic peptide
  XENP019864 vlCDR3
QQYGSSPWT

SEQ ID NO: 5912 - protein, 246 aa, Artificial Sequence
  Description of Artificial Sequence: Synthetic polypeptide
  XENP019865 [CTLA-4]_H0.117_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5913 - protein, 118 aa, Artificial Sequence
  Description of Artificial Sequence: Synthetic polypeptide
  VH of XENP019865
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSS

SEQ ID NO: 5914 - protein, 108 aa, Artificial Sequence; identical to SEQ ID NO: 3741
  Description of Artificial Sequence: Synthetic polypeptide
  VL of XENP019865

SEQ ID NO: 5915 - protein, 5 aa, Artificial Sequence
  Description of Artificial Sequence: Synthetic peptide
  XENP019865 vhCDR1
SYTMH

SEQ ID NO: 5916 - protein, 17 aa, Artificial Sequence
  Description of Artificial Sequence: Synthetic peptide
  XENP019865 vhCDR2
FISYDGNNKYYADSVKG

SEQ ID NO: 5917 - protein, 9 aa, Artificial Sequence
  Description of Artificial Sequence: Synthetic peptide
  XENP019865 vhCDR3
TGWIGPFDY

SEQ ID NO: 5918 - protein, 12 aa, Artificial Sequence
  Description of Artificial Sequence: Synthetic peptide
  XENP019865 vlCDR1
RASQSVGSSYLA

SEQ ID NO: 5919 - protein, 7 aa, Artificial Sequence
  Description of Artificial Sequence: Synthetic peptide
  XENP019865 vlCDR2
GAFSRAT

SEQ ID NO: 5920 - protein, 9 aa, Artificial Sequence
  Description of Artificial Sequence: Synthetic peptide
  XENP019865 vlCDR3
QQYGSSPWT

SEQ ID NO: 5921 - protein, 246 aa, Artificial Sequence
  Description of Artificial Sequence: Synthetic polypeptide
  XENP019866 [CTLA-4]_H0.118_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5922 - protein, 118 aa, Artificial Sequence
  Description of Artificial Sequence: Synthetic polypeptide
  VH of XENP019866
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSS

SEQ ID NO: 5923 - protein, 108 aa, Artificial Sequence; identical to SEQ ID NO: 3741
  Description of Artificial Sequence: Synthetic polypeptide
  VL of XENP019866

SEQ ID NO: 5924 - protein, 5 aa, Artificial Sequence
  Description of Artificial Sequence: Synthetic peptide
  XENP019866 vhCDR1
SYTMH

SEQ ID NO: 5925 - protein, 17 aa, Artificial Sequence
  Description of Artificial Sequence: Synthetic peptide
  XENP019866 vhCDR2
FISYDGNNKYYADSVKG

SEQ ID NO: 5926 - protein, 9 aa, Artificial Sequence
  Description of Artificial Sequence: Synthetic peptide
  XENP019866 vhCDR3
TGWVGPFDY

SEQ ID NO: 5927 - protein, 12 aa, Artificial Sequence
  Description of Artificial Sequence: Synthetic peptide
  XENP019866 vlCDR1
RASQSVGSSYLA

SEQ ID NO: 5928 - protein, 7 aa, Artificial Sequence
  Description of Artificial Sequence: Synthetic peptide
  XENP019866 vlCDR2
GAFSRAT

SEQ ID NO: 5929 - protein, 9 aa, Artificial Sequence
  Description of Artificial Sequence: Synthetic peptide
  XENP019866 vlCDR3
QQYGSSPWT

SEQ ID NO: 5930 - protein, 246 aa, Artificial Sequence
  Description of Artificial Sequence: Synthetic polypeptide
  XENP019867 [CTLA-4]_H0.119_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5931 - protein, 118 aa, Artificial Sequence
  Description of Artificial Sequence: Synthetic polypeptide
  VH of XENP019867
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSS

SEQ ID NO: 5932 - protein, 108 aa, Artificial Sequence; identical to SEQ ID NO: 3741
  Description of Artificial Sequence: Synthetic polypeptide
  VL of XENP019867

SEQ ID NO: 5933 - protein, 5 aa, Artificial Sequence
  Description of Artificial Sequence: Synthetic peptide
  XENP019867 vhCDR1
SYTMH

SEQ ID NO: 5934 - protein, 17 aa, Artificial Sequence
  Description of Artificial Sequence: Synthetic peptide
  XENP019867 vhCDR2
FISYDGNNKYYADSVKG

SEQ ID NO: 5935 - protein, 9 aa, Artificial Sequence
  Description of Artificial Sequence: Synthetic peptide
  XENP019867 vhCDR3
TGWLAPFDY

SEQ ID NO: 5936 - protein, 12 aa, Artificial Sequence
  Description of Artificial Sequence: Synthetic peptide
  XENP019867 vlCDR1
RASQSVGSSYLA

SEQ ID NO: 5937 - protein, 7 aa, Artificial Sequence
  Description of Artificial Sequence: Synthetic peptide
  XENP019867 vlCDR2
GAFSRAT

SEQ ID NO: 5938 - protein, 9 aa, Artificial Sequence
  Description of Artificial Sequence: Synthetic peptide
  XENP019867 vlCDR3
QQYGSSPWT

SEQ ID NO: 5939 - protein, 246 aa, Artificial Sequence
  Description of Artificial Sequence: Synthetic polypeptide
  XENP019868 [CTLA-4]_H0.120_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5940 - protein, 118 aa, Artificial Sequence
  Description of Artificial Sequence: Synthetic polypeptide
  VH of XENP019868
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSS

SEQ ID NO: 5941 - protein, 108 aa, Artificial Sequence; identical to SEQ ID NO: 3741
  Description of Artificial Sequence: Synthetic polypeptide
  VL of XENP019868

SEQ ID NO: 5942 - protein, 5 aa, Artificial Sequence
  Description of Artificial Sequence: Synthetic peptide
  XENP019868 vhCDR1
SYTMH

SEQ ID NO: 5943 - protein, 17 aa, Artificial Sequence
  Description of Artificial Sequence: Synthetic peptide
  XENP019868 vhCDR2
FISYDGNNKYYADSVKG

SEQ ID NO: 5944 - protein, 9 aa, Artificial Sequence
  Description of Artificial Sequence: Synthetic peptide
  XENP019868 vhCDR3
TGWLSPFDY

SEQ ID NO: 5945 - protein, 12 aa, Artificial Sequence
  Description of Artificial Sequence: Synthetic peptide
  XENP019868 vlCDR1
RASQSVGSSYLA

SEQ ID NO: 5946 - protein, 7 aa, Artificial Sequence
  Description of Artificial Sequence: Synthetic peptide
  XENP019868 vlCDR2
GAFSRAT

SEQ ID NO: 5947 - protein, 9 aa, Artificial Sequence
  Description of Artificial Sequence: Synthetic peptide
  XENP019868 vlCDR3
QQYGSSPWT

SEQ ID NO: 5948 - protein, 246 aa, Artificial Sequence
  Description of Artificial Sequence: Synthetic polypeptide
  XENP019869 [CTLA-4]_H0.121_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5949 - protein, 118 aa, Artificial Sequence
  Description of Artificial Sequence: Synthetic polypeptide
  VH of XENP019869
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSS

SEQ ID NO: 5950 - protein, 108 aa, Artificial Sequence; identical to SEQ ID NO: 3741
  Description of Artificial Sequence: Synthetic polypeptide
  VL of XENP019869

SEQ ID NO: 5951 - protein, 5 aa, Artificial Sequence
  Description of Artificial Sequence: Synthetic peptide
  XENP019869 vhCDR1
SYTMH

SEQ ID NO: 5952 - protein, 17 aa, Artificial Sequence
  Description of Artificial Sequence: Synthetic peptide
  XENP019869 vhCDR2
FISYDGNNKYYADSVKG

SEQ ID NO: 5953 - protein, 9 aa, Artificial Sequence
  Description of Artificial Sequence: Synthetic peptide
  XENP019869 vhCDR3
TGWLTPFDY

SEQ ID NO: 5954 - protein, 12 aa, Artificial Sequence
  Description of Artificial Sequence: Synthetic peptide
  XENP019869 vlCDR1
RASQSVGSSYLA

SEQ ID NO: 5955 - protein, 7 aa, Artificial Sequence
  Description of Artificial Sequence: Synthetic peptide
  XENP019869 vlCDR2
GAFSRAT

SEQ ID NO: 5956 - protein, 9 aa, Artificial Sequence
  Description of Artificial Sequence: Synthetic peptide
  XENP019869 vlCDR3
QQYGSSPWT

SEQ ID NO: 5957 - protein, 246 aa, Artificial Sequence
  Description of Artificial Sequence: Synthetic polypeptide
  XENP019870 [CTLA-4]_H0.122_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5958 - protein, 118 aa, Artificial Sequence
  Description of Artificial Sequence: Synthetic polypeptide
  VH of XENP019870
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSS

SEQ ID NO: 5959 - protein, 108 aa, Artificial Sequence; identical to SEQ ID NO: 3741
  Description of Artificial Sequence: Synthetic polypeptide
  VL of XENP019870

SEQ ID NO: 5960 - protein, 5 aa, Artificial Sequence
  Description of Artificial Sequence: Synthetic peptide
  XENP019870 vhCDR1
SYTMH

SEQ ID NO: 5961 - protein, 17 aa, Artificial Sequence
  Description of Artificial Sequence: Synthetic peptide
  XENP019870 vhCDR2
FISYDGNNKYYADSVKG

SEQ ID NO: 5962 - protein, 9 aa, Artificial Sequence
  Description of Artificial Sequence: Synthetic peptide
  XENP019870 vhCDR3
TGWLGPLDY

SEQ ID NO: 5963 - protein, 12 aa, Artificial Sequence
  Description of Artificial Sequence: Synthetic peptide
  XENP019870 vlCDR1
RASQSVGSSYLA

SEQ ID NO: 5964 - protein, 7 aa, Artificial Sequence
  Description of Artificial Sequence: Synthetic peptide
  XENP019870 vlCDR2
GAFSRAT

SEQ ID NO: 5965 - protein, 9 aa, Artificial Sequence
  Description of Artificial Sequence: Synthetic peptide
  XENP019870 vlCDR3
QQYGSSPWT

SEQ ID NO: 5966 - protein, 246 aa, Artificial Sequence
  Description of Artificial Sequence: Synthetic polypeptide
  XENP019871 [CTLA-4]_H0.123_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5967 - protein, 118 aa, Artificial Sequence
  Description of Artificial Sequence: Synthetic polypeptide
  VH of XENP019871
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSS

SEQ ID NO: 5968 - protein, 108 aa, Artificial Sequence; identical to SEQ ID NO: 3741
  Description of Artificial Sequence: Synthetic polypeptide
  VL of XENP019871

SEQ ID NO: 5969 - protein, 5 aa, Artificial Sequence
  Description of Artificial Sequence: Synthetic peptide
  XENP019871 vhCDR1
SYTMH

SEQ ID NO: 5970 - protein, 17 aa, Artificial Sequence
  Description of Artificial Sequence: Synthetic peptide
  XENP019871 vhCDR2
FISYDGNNKYYADSVKG

SEQ ID NO: 5971 - protein, 9 aa, Artificial Sequence
  Description of Artificial Sequence: Synthetic peptide
  XENP019871 vhCDR3
TGWLGPMDY

SEQ ID NO: 5972 - protein, 12 aa, Artificial Sequence
  Description of Artificial Sequence: Synthetic peptide
  XENP019871 vlCDR1
RASQSVGSSYLA

SEQ ID NO: 5973 - protein, 7 aa, Artificial Sequence
  Description of Artificial Sequence: Synthetic peptide
  XENP019871 vlCDR2
GAFSRAT

SEQ ID NO: 5974 - protein, 9 aa, Artificial Sequence
  Description of Artificial Sequence: Synthetic peptide
  XENP019871 vlCDR3
QQYGSSPWT

SEQ ID NO: 5975 - protein, 246 aa, Artificial Sequence
  Description of Artificial Sequence: Synthetic polypeptide
  XENP019872 [CTLA-4]_H0.124_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5976 - protein, 118 aa, Artificial Sequence
  Description of Artificial Sequence: Synthetic polypeptide
  VH of XENP019872
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSS

SEQ ID NO: 5977 - protein, 108 aa, Artificial Sequence; identical to SEQ ID NO: 3741
  Description of Artificial Sequence: Synthetic polypeptide
  VL of XENP019872

SEQ ID NO: 5978 - protein, 5 aa, Artificial Sequence
  Description of Artificial Sequence: Synthetic peptide
  XENP019872 vhCDR1
SYTMH

SEQ ID NO: 5979 - protein, 17 aa, Artificial Sequence
  Description of Artificial Sequence: Synthetic peptide
  XENP019872 vhCDR2
FISYDGNNKYYADSVKG

SEQ ID NO: 5980 - protein, 9 aa, Artificial Sequence
  Description of Artificial Sequence: Synthetic peptide
  XENP019872 vhCDR3
TGWLGPFAY

SEQ ID NO: 5981 - protein, 12 aa, Artificial Sequence
  Description of Artificial Sequence: Synthetic peptide
  XENP019872 vlCDR1
RASQSVGSSYLA

SEQ ID NO: 5982 - protein, 7 aa, Artificial Sequence
  Description of Artificial Sequence: Synthetic peptide
  XENP019872 vlCDR2
GAFSRAT

SEQ ID NO: 5983 - protein, 9 aa, Artificial Sequence
  Description of Artificial Sequence: Synthetic peptide
  XENP019872 vlCDR3
QQYGSSPWT

SEQ ID NO: 5984 - protein, 246 aa, Artificial Sequence
  Description of Artificial Sequence: Synthetic polypeptide
  XENP019873 [CTLA-4]_H0.125_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5985 - protein, 118 aa, Artificial Sequence
  Description of Artificial Sequence: Synthetic polypeptide
  VH of XENP019873
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSS

SEQ ID NO: 5986 - protein, 108 aa, Artificial Sequence; identical to SEQ ID NO: 3741
  Description of Artificial Sequence: Synthetic polypeptide
  VL of XENP019873

SEQ ID NO: 5987 - protein, 5 aa, Artificial Sequence
  Description of Artificial Sequence: Synthetic peptide
  XENP019873 vhCDR1
SYTMH

SEQ ID NO: 5988 - protein, 17 aa, Artificial Sequence
  Description of Artificial Sequence: Synthetic peptide
  XENP019873 vhCDR2
FISYDGNNKYYADSVKG

SEQ ID NO: 5989 - protein, 9 aa, Artificial Sequence
  Description of Artificial Sequence: Synthetic peptide
  XENP019873 vhCDR3
TGWLGPFEY

SEQ ID NO: 5990 - protein, 12 aa, Artificial Sequence
  Description of Artificial Sequence: Synthetic peptide
  XENP019873 vlCDR1
RASQSVGSSYLA

SEQ ID NO: 5991 - protein, 7 aa, Artificial Sequence
  Description of Artificial Sequence: Synthetic peptide
  XENP019873 vlCDR2
GAFSRAT

SEQ ID NO: 5992 - protein, 9 aa, Artificial Sequence
  Description of Artificial Sequence: Synthetic peptide
  XENP019873 vlCDR3
QQYGSSPWT

SEQ ID NO: 5993 - protein, 246 aa, Artificial Sequence
  Description of Artificial Sequence: Synthetic polypeptide
  XENP019874 [CTLA-4]_H0.126_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 5994 - protein, 118 aa, Artificial Sequence
  Description of Artificial Sequence: Synthetic polypeptide
  VH of XENP019874
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSS

SEQ ID NO: 5995 - protein, 108 aa, Artificial Sequence; identical to SEQ ID NO: 3741
  Description of Artificial Sequence: Synthetic polypeptide
  VL of XENP019874

SEQ ID NO: 5996 - protein, 5 aa, Artificial Sequence
  Description of Artificial Sequence: Synthetic peptide
  XENP019874 vhCDR1
SYTMH

SEQ ID NO: 5997 - protein, 17 aa, Artificial Sequence
  Description of Artificial Sequence: Synthetic peptide
  XENP019874 vhCDR2
FISYDGNNKYYADSVKG

SEQ ID NO: 5998 - protein, 9 aa, Artificial Sequence
  Description of Artificial Sequence: Synthetic peptide
  XENP019874 vhCDR3
TGWLGPFHY

SEQ ID NO: 5999 - protein, 12 aa, Artificial Sequence
  Description of Artificial Sequence: Synthetic peptide
  XENP019874 vlCDR1
RASQSVGSSYLA

SEQ ID NO: 6000 - protein, 7 aa, Artificial Sequence
  Description of Artificial Sequence: Synthetic peptide
  XENP019874 vlCDR2
GAFSRAT

SEQ ID NO: 6001 - protein, 9 aa, Artificial Sequence
  Description of Artificial Sequence: Synthetic peptide
  XENP019874 vlCDR3
QQYGSSPWT

SEQ ID NO: 6002 - protein, 246 aa, Artificial Sequence
  Description of Artificial Sequence: Synthetic polypeptide
  XENP019875 [CTLA-4]_H0.127_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6003 - protein, 118 aa, Artificial Sequence
  Description of Artificial Sequence: Synthetic polypeptide
  VH of XENP019875
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSS

SEQ ID NO: 6004 - protein, 108 aa, Artificial Sequence; identical to SEQ ID NO: 3741
  Description of Artificial Sequence: Synthetic polypeptide
  VL of XENP019875

SEQ ID NO: 6005 - protein, 5 aa, Artificial Sequence
  Description of Artificial Sequence: Synthetic peptide
  XENP019875 vhCDR1
SYTMH

SEQ ID NO: 6006 - protein, 17 aa, Artificial Sequence
  Description of Artificial Sequence: Synthetic peptide
  XENP019875 vhCDR2
FISYDGNNKYYADSVKG

SEQ ID NO: 6007 - protein, 9 aa, Artificial Sequence
  Description of Artificial Sequence: Synthetic peptide
  XENP019875 vhCDR3
TGWLGPFNY

SEQ ID NO: 6008 - protein, 12 aa, Artificial Sequence
  Description of Artificial Sequence: Synthetic peptide
  XENP019875 vlCDR1
RASQSVGSSYLA

SEQ ID NO: 6009 - protein, 7 aa, Artificial Sequence
  Description of Artificial Sequence: Synthetic peptide
  XENP019875 vlCDR2
GAFSRAT

SEQ ID NO: 6010 - protein, 9 aa, Artificial Sequence
  Description of Artificial Sequence: Synthetic peptide
  XENP019875 vlCDR3
QQYGSSPWT

SEQ ID NO: 6011 - protein, 246 aa, Artificial Sequence
  Description of Artificial Sequence: Synthetic polypeptide
  XENP019876 [CTLA-4]_H0.128_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6012 - protein, 118 aa, Artificial Sequence
  Description of Artificial Sequence: Synthetic polypeptide
  VH of XENP019876
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSS

SEQ ID NO: 6013 - protein, 108 aa, Artificial Sequence; identical to SEQ ID NO: 3741
  Description of Artificial Sequence: Synthetic polypeptide
  VL of XENP019876

SEQ ID NO: 6014 - protein, 5 aa, Artificial Sequence
  Description of Artificial Sequence: Synthetic peptide
  XENP019876 vhCDR1
SYTMH

SEQ ID NO: 6015 - protein, 17 aa, Artificial Sequence
  Description of Artificial Sequence: Synthetic peptide
  XENP019876 vhCDR2
FISYDGNNKYYADSVKG

SEQ ID NO: 6016 - protein, 9 aa, Artificial Sequence
  Description of Artificial Sequence: Synthetic peptide
  XENP019876 vhCDR3
TGWLGPFSY

SEQ ID NO: 6017 - protein, 12 aa, Artificial Sequence
  Description of Artificial Sequence: Synthetic peptide
  XENP019876 vlCDR1
RASQSVGSSYLA

SEQ ID NO: 6018 - protein, 7 aa, Artificial Sequence
  Description of Artificial Sequence: Synthetic peptide
  XENP019876 vlCDR2
GAFSRAT

SEQ ID NO: 6019 - protein, 9 aa, Artificial Sequence
  Description of Artificial Sequence: Synthetic peptide
  XENP019876 vlCDR3
QQYGSSPWT

SEQ ID NO: 6020 - protein, 246 aa, Artificial Sequence
  Description of Artificial Sequence: Synthetic polypeptide
  XENP019877 [CTLA-4]_H0.129_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6021 - protein, 118 aa, Artificial Sequence
  Description of Artificial Sequence: Synthetic polypeptide
  VH of XENP019877
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSS

SEQ ID NO: 6022 - protein, 108 aa, Artificial Sequence; identical to SEQ ID NO: 3741
  Description of Artificial Sequence: Synthetic polypeptide
  VL of XENP019877

SEQ ID NO: 6023 - protein, 5 aa, Artificial Sequence
  Description of Artificial Sequence: Synthetic peptide
  XENP019877 vhCDR1
SYTMH

SEQ ID NO: 6024 - protein, 17 aa, Artificial Sequence
  Description of Artificial Sequence: Synthetic peptide
  XENP019877 vhCDR2
FISYDGNNKYYADSVKG

SEQ ID NO: 6025 - protein, 9 aa, Artificial Sequence
  Description of Artificial Sequence: Synthetic peptide
  XENP019877 vhCDR3
TGWLGPFQY

SEQ ID NO: 6026 - protein, 12 aa, Artificial Sequence
  Description of Artificial Sequence: Synthetic peptide
  XENP019877 vlCDR1
RASQSVGSSYLA

SEQ ID NO: 6027 - protein, 7 aa, Artificial Sequence
  Description of Artificial Sequence: Synthetic peptide
  XENP019877 vlCDR2
GAFSRAT

SEQ ID NO: 6028 - protein, 9 aa, Artificial Sequence
  Description of Artificial Sequence: Synthetic peptide
  XENP019877 vlCDR3
QQYGSSPWT

SEQ ID NO: 6029 - protein, 246 aa, Artificial Sequence
  Description of Artificial Sequence: Synthetic polypeptide
  XENP019878 [CTLA-4]_H0.130_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6030 - protein, 118 aa, Artificial Sequence
  Description of Artificial Sequence: Synthetic polypeptide
  VH of XENP019878
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSS

SEQ ID NO: 6031 - protein, 108 aa, Artificial Sequence; identical to SEQ ID NO: 3741
  Description of Artificial Sequence: Synthetic polypeptide
  VL of XENP019878

SEQ ID NO: 6032 - protein, 5 aa, Artificial Sequence
  Description of Artificial Sequence: Synthetic peptide
  XENP019878 vhCDR1
SYTMH

SEQ ID NO: 6033 - protein, 17 aa, Artificial Sequence
  Description of Artificial Sequence: Synthetic peptide
  XENP019878 vhCDR2
FISYDGNNKYYADSVKG

SEQ ID NO: 6034 - protein, 9 aa, Artificial Sequence
  Description of Artificial Sequence: Synthetic peptide
  XENP019878 vhCDR3
TGWLGPFDH

SEQ ID NO: 6035 - protein, 12 aa, Artificial Sequence
  Description of Artificial Sequence: Synthetic peptide
  XENP019878 vlCDR1
RASQSVGSSYLA

SEQ ID NO: 6036 - protein, 7 aa, Artificial Sequence
  Description of Artificial Sequence: Synthetic peptide
  XENP019878 vlCDR2
GAFSRAT

SEQ ID NO: 6037 - protein, 9 aa, Artificial Sequence
  Description of Artificial Sequence: Synthetic peptide
  XENP019878 vlCDR3
QQYGSSPWT

SEQ ID NO: 6038 - protein, 246 aa, Artificial Sequence
  Description of Artificial Sequence: Synthetic polypeptide
  XENP019879 [CTLA-4]_H0.131_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6039 - protein, 118 aa, Artificial Sequence
  Description of Artificial Sequence: Synthetic polypeptide
  VH of XENP019879
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSS

SEQ ID NO: 6040 - protein, 108 aa, Artificial Sequence; identical to SEQ ID NO: 3741
  Description of Artificial Sequence: Synthetic polypeptide
  VL of XENP019879

SEQ ID NO: 6041 - protein, 5 aa, Artificial Sequence
  Description of Artificial Sequence: Synthetic peptide
  XENP019879 vhCDR1
SYTMH

SEQ ID NO: 6042 - protein, 17 aa, Artificial Sequence
  Description of Artificial Sequence: Synthetic peptide
  XENP019879 vhCDR2
FISYDGNNKYYADSVKG

SEQ ID NO: 6043 - protein, 9 aa, Artificial Sequence
  Description of Artificial Sequence: Synthetic peptide
  XENP019879 vhCDR3
TGWLGPFDL

SEQ ID NO: 6044 - protein, 12 aa, Artificial Sequence
  Description of Artificial Sequence: Synthetic peptide
  XENP019879 vlCDR1
RASQSVGSSYLA

SEQ ID NO: 6045 - protein, 7 aa, Artificial Sequence
  Description of Artificial Sequence: Synthetic peptide
  XENP019879 vlCDR2
GAFSRAT

SEQ ID NO: 6046 - protein, 9 aa, Artificial Sequence
  Description of Artificial Sequence: Synthetic peptide
  XENP019879 vlCDR3
QQYGSSPWT

SEQ ID NO: 6047 - protein, 246 aa, Artificial Sequence
  Description of Artificial Sequence: Synthetic polypeptide
  XENP019880 [CTLA-4]_H0.132_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6048 - protein, 118 aa, Artificial Sequence
  Description of Artificial Sequence: Synthetic polypeptide
  VH of XENP019880
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSS

SEQ ID NO: 6049 - protein, 108 aa, Artificial Sequence; identical to SEQ ID NO: 3741
  Description of Artificial Sequence: Synthetic polypeptide
  VL of XENP019880

SEQ ID NO: 6050 - protein, 5 aa, Artificial Sequence
  Description of Artificial Sequence: Synthetic peptide
  XENP019880 vhCDR1
SYTMH

SEQ ID NO: 6051 - protein, 17 aa, Artificial Sequence
  Description of Artificial Sequence: Synthetic peptide
  XENP019880 vhCDR2
FISYDGNNKYYADSVKG

SEQ ID NO: 6052 - protein, 9 aa, Artificial Sequence
  Description of Artificial Sequence: Synthetic peptide
  XENP019880 vhCDR3
TGWLGPFDS

SEQ ID NO: 6053 - protein, 12 aa, Artificial Sequence
  Description of Artificial Sequence: Synthetic peptide
  XENP019880 vlCDR1
RASQSVGSSYLA

SEQ ID NO: 6054 - protein, 7 aa, Artificial Sequence
  Description of Artificial Sequence: Synthetic peptide
  XENP019880 vlCDR2
GAFSRAT

SEQ ID NO: 6055 - protein, 9 aa, Artificial Sequence
  Description of Artificial Sequence: Synthetic peptide
  XENP019880 vlCDR3
QQYGSSPWT

SEQ ID NO: 6056 - protein, 246 aa, Artificial Sequence
  Description of Artificial Sequence: Synthetic polypeptide
  XENP019881 [CTLA-4]_H0.133_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6057 - protein, 118 aa, Artificial Sequence
  Description of Artificial Sequence: Synthetic polypeptide
  VH of XENP019881
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSS

SEQ ID NO: 6058 - protein, 108 aa, Artificial Sequence; identical to SEQ ID NO: 3741
  Description of Artificial Sequence: Synthetic polypeptide
  VL of XENP019881

SEQ ID NO: 6059 - protein, 5 aa, Artificial Sequence
  Description of Artificial Sequence: Synthetic peptide
  XENP019881 vhCDR1
SYTMH

SEQ ID NO: 6060 - protein, 17 aa, Artificial Sequence
  Description of Artificial Sequence: Synthetic peptide
  XENP019881 vhCDR2
FISYDGNNKYYADSVKG

SEQ ID NO: 6061 - protein, 9 aa, Artificial Sequence
  Description of Artificial Sequence: Synthetic peptide
  XENP019881 vhCDR3
TGWLGPFDV

SEQ ID NO: 6062 - protein, 12 aa, Artificial Sequence
  Description of Artificial Sequence: Synthetic peptide
  XENP019881 vlCDR1
RASQSVGSSYLA

SEQ ID NO: 6063 - protein, 7 aa, Artificial Sequence
  Description of Artificial Sequence: Synthetic peptide
  XENP019881 vlCDR2
GAFSRAT

SEQ ID NO: 6064 - protein, 9 aa, Artificial Sequence
  Description of Artificial Sequence: Synthetic peptide
  XENP019881 vlCDR3
QQYGSSPWT

SEQ ID NO: 6065 - protein, 246 aa, Artificial Sequence
  Description of Artificial Sequence: Synthetic polypeptide
  XENP019882 [CTLA-4]_H0.134_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6066 - protein, 118 aa, Artificial Sequence; identical to SEQ ID NO: 4743
  Description of Artificial Sequence: Synthetic polypeptide
  VH of XENP019882

SEQ ID NO: 6067 - protein, 108 aa, Artificial Sequence; identical to SEQ ID NO: 3741
  Description of Artificial Sequence: Synthetic polypeptide
  VL of XENP019882

SEQ ID NO: 6068 - protein, 5 aa, Artificial Sequence
  Description of Artificial Sequence: Synthetic peptide
  XENP019882 vhCDR1
SYTMH

SEQ ID NO: 6069 - protein, 17 aa, Artificial Sequence
  Description of Artificial Sequence: Synthetic peptide
  XENP019882 vhCDR2
FISYDGNNKYYADSVKG

SEQ ID NO: 6070 - protein, 9 aa, Artificial Sequence
  Description of Artificial Sequence: Synthetic peptide
  XENP019882 vhCDR3
TGWLGPFDY

SEQ ID NO: 6071 - protein, 12 aa, Artificial Sequence
  Description of Artificial Sequence: Synthetic peptide
  XENP019882 vlCDR1
RASQSVGSSYLA

SEQ ID NO: 6072 - protein, 7 aa, Artificial Sequence
  Description of Artificial Sequence: Synthetic peptide
  XENP019882 vlCDR2
GAFSRAT

SEQ ID NO: 6073 - protein, 9 aa, Artificial Sequence
  Description of Artificial Sequence: Synthetic peptide
  XENP019882 vlCDR3
QQYGSSPWT

SEQ ID NO: 6074 - protein, 246 aa, Artificial Sequence
  Description of Artificial Sequence: Synthetic polypeptide
  XENP019883 [CTLA-4]_H0.135_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6075 - protein, 118 aa, Artificial Sequence
  Description of Artificial Sequence: Synthetic polypeptide
  VH of XENP019883
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSS

SEQ ID NO: 6076 - protein, 108 aa, Artificial Sequence; identical to SEQ ID NO: 3741
  Description of Artificial Sequence: Synthetic polypeptide
  VL of XENP019883

SEQ ID NO: 6077 - protein, 5 aa, Artificial Sequence
  Description of Artificial Sequence: Synthetic peptide
  XENP019883 vhCDR1
SYTMH

SEQ ID NO: 6078 - protein, 17 aa, Artificial Sequence
  Description of Artificial Sequence: Synthetic peptide
  XENP019883 vhCDR2
FISYDGNNKYYADSVKG

SEQ ID NO: 6079 - protein, 9 aa, Artificial Sequence
  Description of Artificial Sequence: Synthetic peptide
  XENP019883 vhCDR3
TGWLGPFDY

SEQ ID NO: 6080 - protein, 12 aa, Artificial Sequence
  Description of Artificial Sequence: Synthetic peptide
  XENP019883 vlCDR1
RASQSVGSSYLA

SEQ ID NO: 6081 - protein, 7 aa, Artificial Sequence
  Description of Artificial Sequence: Synthetic peptide
  XENP019883 vlCDR2
GAFSRAT

SEQ ID NO: 6082 - protein, 9 aa, Artificial Sequence
  Description of Artificial Sequence: Synthetic peptide
  XENP019883 vlCDR3
QQYGSSPWT

SEQ ID NO: 6083 - protein, 246 aa, Artificial Sequence
  Description of Artificial Sequence: Synthetic polypeptide
  XENP019884 [CTLA-4]_H0.136_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6084 - protein, 118 aa, Artificial Sequence
  Description of Artificial Sequence: Synthetic polypeptide
  VH of XENP019884
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSS

SEQ ID NO: 6085 - protein, 108 aa, Artificial Sequence; identical to SEQ ID NO: 3741
  Description of Artificial Sequence: Synthetic polypeptide
  VL of XENP019884

SEQ ID NO: 6086 - protein, 5 aa, Artificial Sequence
  Description of Artificial Sequence: Synthetic peptide
  XENP019884 vhCDR1
SYTMH

SEQ ID NO: 6087 - protein, 17 aa, Artificial Sequence
  Description of Artificial Sequence: Synthetic peptide
  XENP019884 vhCDR2
FISYDGNNKYYADSVKG

SEQ ID NO: 6088 - protein, 9 aa, Artificial Sequence
  Description of Artificial Sequence: Synthetic peptide
  XENP019884 vhCDR3
TGWLGPFDY

SEQ ID NO: 6089 - protein, 12 aa, Artificial Sequence
  Description of Artificial Sequence: Synthetic peptide
  XENP019884 vlCDR1
RASQSVGSSYLA

SEQ ID NO: 6090 - protein, 7 aa, Artificial Sequence
  Description of Artificial Sequence: Synthetic peptide
  XENP019884 vlCDR2
GAFSRAT

SEQ ID NO: 6091 - protein, 9 aa, Artificial Sequence
  Description of Artificial Sequence: Synthetic peptide
  XENP019884 vlCDR3
QQYGSSPWT

SEQ ID NO: 6092 - protein, 246 aa, Artificial Sequence
  Description of Artificial Sequence: Synthetic polypeptide
  XENP019885 [CTLA-4]_H0_L0.1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSAIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6093 - protein, 118 aa, Artificial Sequence; identical to SEQ ID NO: 3737
  Description of Artificial Sequence: Synthetic polypeptide
  VH of XENP019885

SEQ ID NO: 6094 - protein, 108 aa, Artificial Sequence
  Description of Artificial Sequence: Synthetic polypeptide
  VL of XENP019885
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6095 - protein, 5 aa, Artificial Sequence
  Description of Artificial Sequence: Synthetic peptide
  XENP019885 vhCDR1
SYTMH

SEQ ID NO: 6096 - protein, 17 aa, Artificial Sequence
  Description of Artificial Sequence: Synthetic peptide
  XENP019885 vhCDR2
FISYDGNNKYYADSVKG

SEQ ID NO: 6097 - protein, 9 aa, Artificial Sequence
  Description of Artificial Sequence: Synthetic peptide
  XENP019885 vhCDR3
TGWLGPFDY

SEQ ID NO: 6098 - protein, 12 aa, Artificial Sequence
  Description of Artificial Sequence: Synthetic peptide
  XENP019885 vlCDR1
RASQSVGSSYLA

SEQ ID NO: 6099 - protein, 7 aa, Artificial Sequence
  Description of Artificial Sequence: Synthetic peptide
  XENP019885 vlCDR2
GAFSRAT

SEQ ID NO: 6100 - protein, 9 aa, Artificial Sequence
  Description of Artificial Sequence: Synthetic peptide
  XENP019885 vlCDR3
QQYGSSPWT

SEQ ID NO: 6101 - protein, 246 aa, Artificial Sequence
  Description of Artificial Sequence: Synthetic polypeptide
  XENP019886 [CTLA-4]_H0_L0.2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSDIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6102 - protein, 118 aa, Artificial Sequence; identical to SEQ ID NO: 3737
  Description of Artificial Sequence: Synthetic polypeptide
  VH of XENP019886

SEQ ID NO: 6103 - protein, 108 aa, Artificial Sequence
  Description of Artificial Sequence: Synthetic polypeptide
  VL of XENP019886
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6104 - protein, 5 aa, Artificial Sequence
  Description of Artificial Sequence: Synthetic peptide
  XENP019886 vhCDR1
SYTMH

SEQ ID NO: 6105 - protein, 17 aa, Artificial Sequence
  Description of Artificial Sequence: Synthetic peptide
  XENP019886 vhCDR2
FISYDGNNKYYADSVKG

SEQ ID NO: 6106 - protein, 9 aa, Artificial Sequence
  Description of Artificial Sequence: Synthetic peptide
  XENP019886 vhCDR3
TGWLGPFDY

SEQ ID NO: 6107 - protein, 12 aa, Artificial Sequence
  Description of Artificial Sequence: Synthetic peptide
  XENP019886 vlCDR1
RASQSVGSSYLA

SEQ ID NO: 6108 - protein, 7 aa, Artificial Sequence
  Description of Artificial Sequence: Synthetic peptide
  XENP019886 vlCDR2
GAFSRAT

SEQ ID NO: 6109 - protein, 9 aa, Artificial Sequence
  Description of Artificial Sequence: Synthetic peptide
  XENP019886 vlCDR3
QQYGSSPWT

SEQ ID NO: 6110 - protein, 246 aa, Artificial Sequence
  Description of Artificial Sequence: Synthetic polypeptide
  XENP019887 [CTLA-4]_H0_L0.3_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSQIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6111 - protein, 118 aa, Artificial Sequence; identical to SEQ ID NO: 3737
  Description of Artificial Sequence: Synthetic polypeptide
  VH of XENP019887

SEQ ID NO: 6112 - protein, 108 aa, Artificial Sequence
  Description of Artificial Sequence: Synthetic polypeptide
  VL of XENP019887
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6113 - protein, 5 aa, Artificial Sequence
  Description of Artificial Sequence: Synthetic peptide
  XENP019887 vhCDR1
SYTMH

SEQ ID NO: 6114 - protein, 17 aa, Artificial Sequence
  Description of Artificial Sequence: Synthetic peptide
  XENP019887 vhCDR2
FISYDGNNKYYADSVKG

SEQ ID NO: 6115 - protein, 9 aa, Artificial Sequence
  Description of Artificial Sequence: Synthetic peptide
  XENP019887 vhCDR3
TGWLGPFDY

SEQ ID NO: 6116 - protein, 12 aa, Artificial Sequence
  Description of Artificial Sequence: Synthetic peptide
  XENP019887 vlCDR1
RASQSVGSSYLA

SEQ ID NO: 6117 - protein, 7 aa, Artificial Sequence
  Description of Artificial Sequence: Synthetic peptide
  XENP019887 vlCDR2
GAFSRAT

SEQ ID NO: 6118 - protein, 9 aa, Artificial Sequence
  Description of Artificial Sequence: Synthetic peptide
  XENP019887 vlCDR3
QQYGSSPWT

SEQ ID NO: 6119 - protein, 246 aa, Artificial Sequence
  Description of Artificial Sequence: Synthetic polypeptide
  XENP019888 [CTLA-4]_H0_L0.4_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSRIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6120 - protein, 118 aa, Artificial Sequence; identical to SEQ ID NO: 3737
  Description of Artificial Sequence: Synthetic polypeptide
  VH of XENP019888

SEQ ID NO: 6121 - protein, 108 aa, Artificial Sequence
  Description of Artificial Sequence: Synthetic polypeptide
  VL of XENP019888
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6122 - protein, 5 aa, Artificial Sequence
  Description of Artificial Sequence: Synthetic peptide
  XENP019888 vhCDR1
SYTMH

SEQ ID NO: 6123 - protein, 17 aa, Artificial Sequence
  Description of Artificial Sequence: Synthetic peptide
  XENP019888 vhCDR2
FISYDGNNKYYADSVKG

SEQ ID NO: 6124 - protein, 9 aa, Artificial Sequence
  Description of Artificial Sequence: Synthetic peptide
  XENP019888 vhCDR3
TGWLGPFDY

SEQ ID NO: 6125 - protein, 12 aa, Artificial Sequence
  Description of Artificial Sequence: Synthetic peptide
  XENP019888 vlCDR1
RASQSVGSSYLA

SEQ ID NO: 6126 - protein, 7 aa, Artificial Sequence
  Description of Artificial Sequence: Synthetic peptide
  XENP019888 vlCDR2
GAFSRAT

SEQ ID NO: 6127 - protein, 9 aa, Artificial Sequence
  Description of Artificial Sequence: Synthetic peptide
  XENP019888 vlCDR3
QQYGSSPWT

SEQ ID NO: 6128 - protein, 246 aa, Artificial Sequence
  Description of Artificial Sequence: Synthetic polypeptide
  XENP019889 [CTLA-4]_H0_L0.5_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6129 - protein, 118 aa, Artificial Sequence; identical to SEQ ID NO: 3737
  Description of Artificial Sequence: Synthetic polypeptide
  VH of XENP019889

SEQ ID NO: 6130 - protein, 108 aa, Artificial Sequence
  Description of Artificial Sequence: Synthetic polypeptide
  VL of XENP019889
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6131 - protein, 5 aa, Artificial Sequence
  Description of Artificial Sequence: Synthetic peptide
  XENP019889 vhCDR1
SYTMH

SEQ ID NO: 6132 - protein, 17 aa, Artificial Sequence
  Description of Artificial Sequence: Synthetic peptide
  XENP019889 vhCDR2
FISYDGNNKYYADSVKG

SEQ ID NO: 6133 - protein, 9 aa, Artificial Sequence
  Description of Artificial Sequence: Synthetic peptide
  XENP019889 vhCDR3
TGWLGPFDY

SEQ ID NO: 6134 - protein, 12 aa, Artificial Sequence
  Description of Artificial Sequence: Synthetic peptide
  XENP019889 vlCDR1
RASQSVGSSYLA

SEQ ID NO: 6135 - protein, 7 aa, Artificial Sequence
  Description of Artificial Sequence: Synthetic peptide
  XENP019889 vlCDR2
GAFSRAT

SEQ ID NO: 6136 - protein, 9 aa, Artificial Sequence
  Description of Artificial Sequence: Synthetic peptide
  XENP019889 vlCDR3
QQYGSSPWT

SEQ ID NO: 6137 - protein, 246 aa, Artificial Sequence
  Description of Artificial Sequence: Synthetic polypeptide
  XENP019890 [CTLA-4]_H0_L0.6_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 6138 - protein, 118 aa, Artificial Sequence; identical to SEQ ID NO: 3737
  Description of Artificial Sequence: Synthetic polypeptide
  VH of XENP019890

SEQ ID NO: 6139 - protein, 108 aa, Artificial Sequence
  Description of Artificial Sequence: Synthetic polypeptide
  VL of XENP019890
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 6140 - protein, 5 aa, Artificial Sequence
  Description of Artificial Sequence: Synthetic peptide
  XENP019890 vhCDR1
SYTMH

SEQ ID NO: 6141 - protein, 17 aa, Artificial Sequence
  Description of Artificial Sequence: Synthetic peptide
  XENP019890 vhCDR2
FISYDGNNKYYADSVKG

SEQ ID NO: 6142 - protein, 9 aa, Artificial Sequence
  Description of Artificial Sequence: Synthetic peptide
  XENP019890 vhCDR3
TGWLGPFDY

SEQ ID NO: 6143 - protein, 12 aa, Artificial Sequence
  Description of Artificial Sequence: Synthetic peptide
  XENP019890 vlCDR1
RASQSVGSSYLA

SEQ ID NO: 6144 - protein, 7 aa, Artificial Sequence
  Description of Artificial Sequence: Synthetic peptide
  XENP019890 vlCDR2
GAFSRAT

SEQ ID NO: 6145 - protein, 9 aa, Artificial Sequence
  Description of Artificial Sequence: Synthetic peptide
  XENP019890 vlCDR3
QQYGSSPWT

SEQ ID NO: 6146 - protein, 246 aa, Artificial Sequence
  Description of Artificial Sequence: Synthetic polypeptide
  XENP019891 [CTLA-4]_H0_L0.7_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6147 - protein, 118 aa, Artificial Sequence; identical to SEQ ID NO: 3737
  Description of Artificial Sequence: Synthetic polypeptide
  VH of XENP019891

SEQ ID NO: 6148 - protein, 108 aa, Artificial Sequence
  Description of Artificial Sequence: Synthetic polypeptide
  VL of XENP019891
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6149 - protein, 5 aa, Artificial Sequence
  Description of Artificial Sequence: Synthetic peptide
  XENP019891 vhCDR1
SYTMH

SEQ ID NO: 6150 - protein, 17 aa, Artificial Sequence
  Description of Artificial Sequence: Synthetic peptide
  XENP019891 vhCDR2
FISYDGNNKYYADSVKG

SEQ ID NO: 6151 - protein, 9 aa, Artificial Sequence
  Description of Artificial Sequence: Synthetic peptide
  XENP019891 vhCDR3
TGWLGPFDY

SEQ ID NO: 6152 - protein, 12 aa, Artificial Sequence
  Description of Artificial Sequence: Synthetic peptide
  XENP019891 vlCDR1
RASQSVGSSYLA

SEQ ID NO: 6153 - protein, 7 aa, Artificial Sequence
  Description of Artificial Sequence: Synthetic peptide
  XENP019891 vlCDR2
GAFSRAT

SEQ ID NO: 6154 - protein, 9 aa, Artificial Sequence
  Description of Artificial Sequence: Synthetic peptide
  XENP019891 vlCDR3
QQYGSSPWT

SEQ ID NO: 6155 - protein, 246 aa, Artificial Sequence
  Description of Artificial Sequence: Synthetic polypeptide
  XENP019892 [CTLA-4]_H0_L0.8_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6156 - protein, 118 aa, Artificial Sequence; identical to SEQ ID NO: 3737
  Description of Artificial Sequence: Synthetic polypeptide
  VH of XENP019892

SEQ ID NO: 6157 - protein, 108 aa, Artificial Sequence
  Description of Artificial Sequence: Synthetic polypeptide
  VL of XENP019892
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6158 - protein, 5 aa, Artificial Sequence
  Description of Artificial Sequence: Synthetic peptide
  XENP019892 vhCDR1
SYTMH

SEQ ID NO: 6159 - protein, 17 aa, Artificial Sequence
  Description of Artificial Sequence: Synthetic peptide
  XENP019892 vhCDR2
FISYDGNNKYYADSVKG

SEQ ID NO: 6160 - protein, 9 aa, Artificial Sequence
  Description of Artificial Sequence: Synthetic peptide
  XENP019892 vhCDR3
TGWLGPFDY

SEQ ID NO: 6161 - protein, 12 aa, Artificial Sequence
  Description of Artificial Sequence: Synthetic peptide
  XENP019892 vlCDR1
RASQSVGSSYLA

SEQ ID NO: 6162 - protein, 7 aa, Artificial Sequence
  Description of Artificial Sequence: Synthetic peptide
  XENP019892 vlCDR2
GAFSRAT

SEQ ID NO: 6163 - protein, 9 aa, Artificial Sequence
  Description of Artificial Sequence: Synthetic peptide
  XENP019892 vlCDR3
QQYGSSPWT

SEQ ID NO: 6164 - protein, 246 aa, Artificial Sequence
  Description of Artificial Sequence: Synthetic polypeptide
  XENP019893 [CTLA-4]_H0_L0.9_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6165 - protein, 118 aa, Artificial Sequence; identical to SEQ ID NO: 3737
  Description of Artificial Sequence: Synthetic polypeptide
  VH of XENP019893

SEQ ID NO: 6166 - protein, 108 aa, Artificial Sequence
  Description of Artificial Sequence: Synthetic polypeptide
  VL of XENP019893
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6167 - protein, 5 aa, Artificial Sequence
  Description of Artificial Sequence: Synthetic peptide
  XENP019893 vhCDR1
SYTMH

SEQ ID NO: 6168 - protein, 17 aa, Artificial Sequence
  Description of Artificial Sequence: Synthetic peptide
  XENP019893 vhCDR2
FISYDGNNKYYADSVKG

SEQ ID NO: 6169 - protein, 9 aa, Artificial Sequence
  Description of Artificial Sequence: Synthetic peptide
  XENP019893 vhCDR3
TGWLGPFDY

SEQ ID NO: 6170 - protein, 12 aa, Artificial Sequence
  Description of Artificial Sequence: Synthetic peptide
  XENP019893 vlCDR1
RASQSVGSSYLA

SEQ ID NO: 6171 - protein, 7 aa, Artificial Sequence
  Description of Artificial Sequence: Synthetic peptide
  XENP019893 vlCDR2
GAFSRAT

SEQ ID NO: 6172 - protein, 9 aa, Artificial Sequence
  Description of Artificial Sequence: Synthetic peptide
  XENP019893 vlCDR3
QQYGSSPWT

SEQ ID NO: 6173 - protein, 246 aa, Artificial Sequence
  Description of Artificial Sequence: Synthetic polypeptide
  XENP019894 [CTLA-4]_H0_L0.10_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6174 - protein, 118 aa, Artificial Sequence; identical to SEQ ID NO: 3737
  Description of Artificial Sequence: Synthetic polypeptide
  VH of XENP019894

SEQ ID NO: 6175 - protein, 108 aa, Artificial Sequence
  Description of Artificial Sequence: Synthetic polypeptide
  VL of XENP019894
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6176 - protein, 5 aa, Artificial Sequence
  Description of Artificial Sequence: Synthetic peptide
  XENP019894 vhCDR1
SYTMH

SEQ ID NO: 6177 - protein, 17 aa, Artificial Sequence
  Description of Artificial Sequence: Synthetic peptide
  XENP019894 vhCDR2
FISYDGNNKYYADSVKG

SEQ ID NO: 6178 - protein, 9 aa, Artificial Sequence
  Description of Artificial Sequence: Synthetic peptide
  XENP019894 vhCDR3
TGWLGPFDY

SEQ ID NO: 6179 - protein, 12 aa, Artificial Sequence
  Description of Artificial Sequence: Synthetic peptide
  XENP019894 vlCDR1
RASQSVGSSYLA

SEQ ID NO: 6180 - protein, 7 aa, Artificial Sequence
  Description of Artificial Sequence: Synthetic peptide
  XENP019894 vlCDR2
GAFSRAT

SEQ ID NO: 6181 - protein, 9 aa, Artificial Sequence
  Description of Artificial Sequence: Synthetic peptide
  XENP019894 vlCDR3
QQYGSSPWT

SEQ ID NO: 6182 - protein, 246 aa, Artificial Sequence
  Description of Artificial Sequence: Synthetic polypeptide
  XENP019895 [CTLA-4]_H0_L0.11_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6183 - protein, 118 aa, Artificial Sequence; identical to SEQ ID NO: 3737
  Description of Artificial Sequence: Synthetic polypeptide
  VH of XENP019895

SEQ ID NO: 6184 - protein, 108 aa, Artificial Sequence
  Description of Artificial Sequence: Synthetic polypeptide
  VL of XENP019895
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6185 - protein, 5 aa, Artificial Sequence
  Description of Artificial Sequence: Synthetic peptide
  XENP019895 vhCDR1
SYTMH

SEQ ID NO: 6186 - protein, 17 aa, Artificial Sequence
  Description of Artificial Sequence: Synthetic peptide
  XENP019895 vhCDR2
FISYDGNNKYYADSVKG

SEQ ID NO: 6187 - protein, 9 aa, Artificial Sequence
  Description of Artificial Sequence: Synthetic peptide
  XENP019895 vhCDR3
TGWLGPFDY

SEQ ID NO: 6188 - protein, 12 aa, Artificial Sequence
  Description of Artificial Sequence: Synthetic peptide
  XENP019895 vlCDR1
RASQSVGSSYLA

SEQ ID NO: 6189 - protein, 7 aa, Artificial Sequence
  Description of Artificial Sequence: Synthetic peptide
  XENP019895 vlCDR2
GAFSRAT

SEQ ID NO: 6190 - protein, 9 aa, Artificial Sequence
  Description of Artificial Sequence: Synthetic peptide
  XENP019895 vlCDR3
QQYGSSPWT

SEQ ID NO: 6191 - protein, 246 aa, Artificial Sequence
  Description of Artificial Sequence: Synthetic polypeptide
  XENP019896 [CTLA-4]_H0_L0.12_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6192 - protein, 118 aa, Artificial Sequence; identical to SEQ ID NO: 3737
  Description of Artificial Sequence: Synthetic polypeptide
  VH of XENP019896

SEQ ID NO: 6193 - protein, 108 aa, Artificial Sequence
  Description of Artificial Sequence: Synthetic polypeptide
  VL of XENP019896
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6194 - protein, 5 aa, Artificial Sequence
  Description of Artificial Sequence: Synthetic peptide
  XENP019896 vhCDR1
SYTMH

SEQ ID NO: 6195 - protein, 17 aa, Artificial Sequence
  Description of Artificial Sequence: Synthetic peptide
  XENP019896 vhCDR2
FISYDGNNKYYADSVKG

SEQ ID NO: 6196 - protein, 9 aa, Artificial Sequence
  Description of Artificial Sequence: Synthetic peptide
  XENP019896 vhCDR3
TGWLGPFDY

SEQ ID NO: 6197 - protein, 12 aa, Artificial Sequence
  Description of Artificial Sequence: Synthetic peptide
  XENP019896 vlCDR1
RASQSVGSSYLA

SEQ ID NO: 6198 - protein, 7 aa, Artificial Sequence
  Description of Artificial Sequence: Synthetic peptide
  XENP019896 vlCDR2
GAFSRAT

SEQ ID NO: 6199 - protein, 9 aa, Artificial Sequence
  Description of Artificial Sequence: Synthetic peptide
  XENP019896 vlCDR3
QQYGSSPWT

SEQ ID NO: 6200 - protein, 246 aa, Artificial Sequence
  Description of Artificial Sequence: Synthetic polypeptide
  XENP019901 [CTLA-4]_H0_L0.13_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6201 - protein, 118 aa, Artificial Sequence; identical to SEQ ID NO: 3737
  Description of Artificial Sequence: Synthetic polypeptide
  VH of XENP019901

SEQ ID NO: 6202 - protein, 108 aa, Artificial Sequence
  Description of Artificial Sequence: Synthetic polypeptide
  VL of XENP019901
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6203 - protein, 5 aa, Artificial Sequence
  Description of Artificial Sequence: Synthetic peptide
  XENP019901 vhCDR1
SYTMH

SEQ ID NO: 6204 - protein, 17 aa, Artificial Sequence
  Description of Artificial Sequence: Synthetic peptide
  XENP019901 vhCDR2
FISYDGNNKYYADSVKG

SEQ ID NO: 6205 - protein, 9 aa, Artificial Sequence
  Description of Artificial Sequence: Synthetic peptide
  XENP019901 vhCDR3
TGWLGPFDY

SEQ ID NO: 6206 - protein, 12 aa, Artificial Sequence
  Description of Artificial Sequence: Synthetic peptide
  XENP019901 vlCDR1
RASQSVGSSYLA

SEQ ID NO: 6207 - protein, 7 aa, Artificial Sequence
  Description of Artificial Sequence: Synthetic peptide
  XENP019901 vlCDR2
GAFSRAT

SEQ ID NO: 6208 - protein, 9 aa, Artificial Sequence
  Description of Artificial Sequence: Synthetic peptide
  XENP019901 vlCDR3
QQYGSSPWT

SEQ ID NO: 6209 - protein, 246 aa, Artificial Sequence
  Description of Artificial Sequence: Synthetic polypeptide
  XENP019902 [CTLA-4]_H0_L0.14_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6210 - protein, 118 aa, Artificial Sequence; identical to SEQ ID NO: 3737
  Description of Artificial Sequence: Synthetic polypeptide
  VH of XENP019902

SEQ ID NO: 6211 - protein, 108 aa, Artificial Sequence
  Description of Artificial Sequence: Synthetic polypeptide
  VL of XENP019902
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6212 - protein, 5 aa, Artificial Sequence
  Description of Artificial Sequence: Synthetic peptide
  XENP019902 vhCDR1
SYTMH

SEQ ID NO: 6213 - protein, 17 aa, Artificial Sequence
  Description of Artificial Sequence: Synthetic peptide
  XENP019902 vhCDR2
FISYDGNNKYYADSVKG

SEQ ID NO: 6214 - protein, 9 aa, Artificial Sequence
  Description of Artificial Sequence: Synthetic peptide
  XENP019902 vhCDR3
TGWLGPFDY

SEQ ID NO: 6215 - protein, 12 aa, Artificial Sequence
  Description of Artificial Sequence: Synthetic peptide
  XENP019902 vlCDR1
RASQSVGSSYLA

SEQ ID NO: 6216 - protein, 7 aa, Artificial Sequence
  Description of Artificial Sequence: Synthetic peptide
  XENP019902 vlCDR2
GAFSRAT

SEQ ID NO: 6217 - protein, 9 aa, Artificial Sequence
  Description of Artificial Sequence: Synthetic peptide
  XENP019902 vlCDR3
QQYGSSPWT

SEQ ID NO: 6218 - protein, 246 aa, Artificial Sequence
  Description of Artificial Sequence: Synthetic polypeptide
  XENP019903 [CTLA-4]_H0_L0.15_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6219 - protein, 118 aa, Artificial Sequence; identical to SEQ ID NO: 3737
  Description of Artificial Sequence: Synthetic polypeptide
  VH of XENP019903

SEQ ID NO: 6220 - protein, 108 aa, Artificial Sequence
  Description of Artificial Sequence: Synthetic polypeptide
  VL of XENP019903
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6221 - protein, 5 aa, Artificial Sequence
  Description of Artificial Sequence: Synthetic peptide
  XENP019903 vhCDR1
SYTMH

SEQ ID NO: 6222 - protein, 17 aa, Artificial Sequence
  Description of Artificial Sequence: Synthetic peptide
  XENP019903 vhCDR2
FISYDGNNKYYADSVKG

SEQ ID NO: 6223 - protein, 9 aa, Artificial Sequence
  Description of Artificial Sequence: Synthetic peptide
  XENP019903 vhCDR3
TGWLGPFDY

SEQ ID NO: 6224 - protein, 12 aa, Artificial Sequence
  Description of Artificial Sequence: Synthetic peptide
  XENP019903 vlCDR1
RASQSVGSSYLA

SEQ ID NO: 6225 - protein, 7 aa, Artificial Sequence
  Description of Artificial Sequence: Synthetic peptide
  XENP019903 vlCDR2
GAFSRAT

SEQ ID NO: 6226 - protein, 9 aa, Artificial Sequence
  Description of Artificial Sequence: Synthetic peptide
  XENP019903 vlCDR3
QQYGSSPWT

SEQ ID NO: 6227 - protein, 246 aa, Artificial Sequence
  Description of Artificial Sequence: Synthetic polypeptide
  XENP019904 [CTLA-4]_H0_L0.16_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6228 - protein, 118 aa, Artificial Sequence; identical to SEQ ID NO: 3737
  Description of Artificial Sequence: Synthetic polypeptide
  VH of XENP019904

SEQ ID NO: 6229 - protein, 108 aa, Artificial Sequence
  Description of Artificial Sequence: Synthetic polypeptide
  VL of XENP019904
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6230 - protein, 5 aa, Artificial Sequence
  Description of Artificial Sequence: Synthetic peptide
  XENP019904 vhCDR1
SYTMH

SEQ ID NO: 6231 - protein, 17 aa, Artificial Sequence
  Description of Artificial Sequence: Synthetic peptide
  XENP019904 vhCDR2
FISYDGNNKYYADSVKG

SEQ ID NO: 6232 - protein, 9 aa, Artificial Sequence
  Description of Artificial Sequence: Synthetic peptide
  XENP019904 vhCDR3
TGWLGPFDY

SEQ ID NO: 6233 - protein, 12 aa, Artificial Sequence
  Description of Artificial Sequence: Synthetic peptide
  XENP019904 vlCDR1
RASQSVGSSYLA

SEQ ID NO: 6234 - protein, 7 aa, Artificial Sequence
  Description of Artificial Sequence: Synthetic peptide
  XENP019904 vlCDR2
GAFSRAT

SEQ ID NO: 6235 - protein, 9 aa, Artificial Sequence
  Description of Artificial Sequence: Synthetic peptide
  XENP019904 vlCDR3
QQYGSSPWT

SEQ ID NO: 6236 - protein, 246 aa, Artificial Sequence
  Description of Artificial Sequence: Synthetic polypeptide
  XENP019905 [CTLA-4]_H0_L0.17_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6237 - protein, 118 aa, Artificial Sequence; identical to SEQ ID NO: 3737
  Description of Artificial Sequence: Synthetic polypeptide
  VH of XENP019905

SEQ ID NO: 6238 - protein, 108 aa, Artificial Sequence
  Description of Artificial Sequence: Synthetic polypeptide
  VL of XENP019905
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6239 - protein, 5 aa, Artificial Sequence
  Description of Artificial Sequence: Synthetic peptide
  XENP019905 vhCDR1
SYTMH

SEQ ID NO: 6240 - protein, 17 aa, Artificial Sequence
  Description of Artificial Sequence: Synthetic peptide
  XENP019905 vhCDR2
FISYDGNNKYYADSVKG

SEQ ID NO: 6241 - protein, 9 aa, Artificial Sequence
  Description of Artificial Sequence: Synthetic peptide
  XENP019905 vhCDR3
TGWLGPFDY

SEQ ID NO: 6242 - protein, 12 aa, Artificial Sequence
  Description of Artificial Sequence: Synthetic peptide
  XENP019905 vlCDR1
RASQSVGSSYLA

SEQ ID NO: 6243 - protein, 7 aa, Artificial Sequence
  Description of Artificial Sequence: Synthetic peptide
  XENP019905 vlCDR2
GAFSRAT

SEQ ID NO: 6244 - protein, 9 aa, Artificial Sequence
  Description of Artificial Sequence: Synthetic peptide
  XENP019905 vlCDR3
QQYGSSPWT

SEQ ID NO: 6245 - protein, 246 aa, Artificial Sequence
  Description of Artificial Sequence: Synthetic polypeptide
  XENP019906 [CTLA-4]_H0_L0.18_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6246 - protein, 118 aa, Artificial Sequence; identical to SEQ ID NO: 3737
  Description of Artificial Sequence: Synthetic polypeptide
  VH of XENP019906

SEQ ID NO: 6247 - protein, 108 aa, Artificial Sequence
  Description of Artificial Sequence: Synthetic polypeptide
  VL of XENP019906
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6248 - protein, 5 aa, Artificial Sequence
  Description of Artificial Sequence: Synthetic peptide
  XENP019906 vhCDR1
SYTMH

SEQ ID NO: 6249 - protein, 17 aa, Artificial Sequence
  Description of Artificial Sequence: Synthetic peptide
  XENP019906 vhCDR2
FISYDGNNKYYADSVKG

SEQ ID NO: 6250 - protein, 9 aa, Artificial Sequence
  Description of Artificial Sequence: Synthetic peptide
  XENP019906 vhCDR3
TGWLGPFDY

SEQ ID NO: 6251 - protein, 12 aa, Artificial Sequence
  Description of Artificial Sequence: Synthetic peptide
  XENP019906 vlCDR1
RSSQSVGSSYLA

SEQ ID NO: 6252 - protein, 7 aa, Artificial Sequence
  Description of Artificial Sequence: Synthetic peptide
  XENP019906 vlCDR2
GAFSRAT

SEQ ID NO: 6253 - protein, 9 aa, Artificial Sequence
  Description of Artificial Sequence: Synthetic peptide
  XENP019906 vlCDR3
QQYGSSPWT

SEQ ID NO: 6254 - protein, 246 aa, Artificial Sequence
  Description of Artificial Sequence: Synthetic polypeptide
  XENP019907 [CTLA-4]_H0_L0.19_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 6255 - protein, 118 aa, Artificial Sequence; identical to SEQ ID NO: 3737
  Description of Artificial Sequence: Synthetic polypeptide
  VH of XENP019907

SEQ ID NO: 6256 - protein, 108 aa, Artificial Sequence
  Description of Artificial Sequence: Synthetic polypeptide
  VL of XENP019907
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 6257 - protein, 5 aa, Artificial Sequence
  Description of Artificial Sequence: Synthetic peptide
  XENP019907 vhCDR1
SYTMH

SEQ ID NO: 6258 - protein, 17 aa, Artificial Sequence
  Description of Artificial Sequence: Synthetic peptide
  XENP019907 vhCDR2
FISYDGNNKYYADSVKG

SEQ ID NO: 6259 - protein, 9 aa, Artificial Sequence
  Description of Artificial Sequence: Synthetic peptide
  XENP019907 vhCDR3
TGWLGPFDY

SEQ ID NO: 6260 - protein, 12 aa, Artificial Sequence
  Description of Artificial Sequence: Synthetic peptide
  XENP019907 vlCDR1
RASQSDGSSYLA

SEQ ID NO: 6261 - protein, 7 aa, Artificial Sequence
  Description of Artificial Sequence: Synthetic peptide
  XENP019907 vlCDR2
GAFSRAT

SEQ ID NO: 6262 - protein, 9 aa, Artificial Sequence
  Description of Artificial Sequence: Synthetic peptide
  XENP019907 vlCDR3
QQYGSSPWT

SEQ ID NO: 6263 - protein, 246 aa, Artificial Sequence
  Description of Artificial Sequence: Synthetic polypeptide
  XENP019908 [CTLA-4]_H0_L0.20_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 6264 - protein, 118 aa, Artificial Sequence; identical to SEQ ID NO: 3737
  Description of Artificial Sequence: Synthetic polypeptide
  VH of XENP019908

SEQ ID NO: 6265 - protein, 108 aa, Artificial Sequence
  Description of Artificial Sequence: Synthetic polypeptide
  VL of XENP019908
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 6266 - protein, 5 aa, Artificial Sequence
  Description of Artificial Sequence: Synthetic peptide
  XENP019908 vhCDR1
SYTMH

SEQ ID NO: 6267 - protein, 17 aa, Artificial Sequence
  Description of Artificial Sequence: Synthetic peptide
  XENP019908 vhCDR2
FISYDGNNKYYADSVKG

SEQ ID NO: 6268 - protein, 9 aa, Artificial Sequence
  Description of Artificial Sequence: Synthetic peptide
  XENP019908 vhCDR3
TGWLGPFDY

SEQ ID NO: 6269 - protein, 12 aa, Artificial Sequence
  Description of Artificial Sequence: Synthetic peptide
  XENP019908 vlCDR1
RASQSSGSSYLA

SEQ ID NO: 6270 - protein, 7 aa, Artificial Sequence
  Description of Artificial Sequence: Synthetic peptide
  XENP019908 vlCDR2
GAFSRAT

SEQ ID NO: 6271 - protein, 9 aa, Artificial Sequence
  Description of Artificial Sequence: Synthetic peptide
  XENP019908 vlCDR3
QQYGSSPWT

SEQ ID NO: 6272 - protein, 246 aa, Artificial Sequence
  Description of Artificial Sequence: Synthetic polypeptide
  XENP019909 [CTLA-4]_H0_L0.21_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 6273 - protein, 118 aa, Artificial Sequence; identical to SEQ ID NO: 3737
  Description of Artificial Sequence: Synthetic polypeptide
  VH of XENP019909

SEQ ID NO: 6274 - protein, 108 aa, Artificial Sequence
  Description of Artificial Sequence: Synthetic polypeptide
  VL of XENP019909
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 6275 - protein, 5 aa, Artificial Sequence
  Description of Artificial Sequence: Synthetic peptide
  XENP019909 vhCDR1
SYTMH

SEQ ID NO: 6276 - protein, 17 aa, Artificial Sequence
  Description of Artificial Sequence: Synthetic peptide
  XENP019909 vhCDR2
FISYDGNNKYYADSVKG

SEQ ID NO: 6277 - protein, 9 aa, Artificial Sequence
  Description of Artificial Sequence: Synthetic peptide
  XENP019909 vhCDR3
TGWLGPFDY

SEQ ID NO: 6278 - protein, 12 aa, Artificial Sequence
  Description of Artificial Sequence: Synthetic peptide
  XENP019909 vlCDR1
RASQSVASSYLA

SEQ ID NO: 6279 - protein, 7 aa, Artificial Sequence
  Description of Artificial Sequence: Synthetic peptide
  XENP019909 vlCDR2
GAFSRAT

SEQ ID NO: 6280 - protein, 9 aa, Artificial Sequence
  Description of Artificial Sequence: Synthetic peptide
  XENP019909 vlCDR3
QQYGSSPWT

SEQ ID NO: 6281 - protein, 246 aa, Artificial Sequence
  Description of Artificial Sequence: Synthetic polypeptide
  XENP019910 [CTLA-4]_H0_L0.22_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 6282 - protein, 118 aa, Artificial Sequence; identical to SEQ ID NO: 3737
  Description of Artificial Sequence: Synthetic polypeptide
  VH of XENP019910

SEQ ID NO: 6283 - protein, 108 aa, Artificial Sequence; identical to SEQ ID NO: 2411
  Description of Artificial Sequence: Synthetic polypeptide
  VL of XENP019910

SEQ ID NO: 6284 - protein, 5 aa, Artificial Sequence
  Description of Artificial Sequence: Synthetic peptide
  XENP019910 vhCDR1
SYTMH

SEQ ID NO: 6285 - protein, 17 aa, Artificial Sequence
  Description of Artificial Sequence: Synthetic peptide
  XENP019910 vhCDR2
FISYDGNNKYYADSVKG

SEQ ID NO: 6286 - protein, 9 aa, Artificial Sequence
  Description of Artificial Sequence: Synthetic peptide
  XENP019910 vhCDR3
TGWLGPFDY

SEQ ID NO: 6287 - protein, 12 aa, Artificial Sequence
  Description of Artificial Sequence: Synthetic peptide
  XENP019910 vlCDR1
RASQSVSSSYLA

SEQ ID NO: 6288 - protein, 7 aa, Artificial Sequence
  Description of Artificial Sequence: Synthetic peptide
  XENP019910 vlCDR2
GAFSRAT

SEQ ID NO: 6289 - protein, 9 aa, Artificial Sequence
  Description of Artificial Sequence: Synthetic peptide
  XENP019910 vlCDR3
QQYGSSPWT

SEQ ID NO: 6290 - protein, 246 aa, Artificial Sequence
  Description of Artificial Sequence: Synthetic polypeptide
  XENP019911 [CTLA-4]_H0_L0.23_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 6291 - protein, 118 aa, Artificial Sequence; identical to SEQ ID NO: 3737
  Description of Artificial Sequence: Synthetic polypeptide
  VH of XENP019911

SEQ ID NO: 6292 - protein, 108 aa, Artificial Sequence
  Description of Artificial Sequence: Synthetic polypeptide
  VL of XENP019911
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 6293 - protein, 5 aa, Artificial Sequence
  Description of Artificial Sequence: Synthetic peptide
  XENP019911 vhCDR1
SYTMH

SEQ ID NO: 6294 - protein, 17 aa, Artificial Sequence
  Description of Artificial Sequence: Synthetic peptide
  XENP019911 vhCDR2
FISYDGNNKYYADSVKG

SEQ ID NO: 6295 - protein, 9 aa, Artificial Sequence
  Description of Artificial Sequence: Synthetic peptide
  XENP019911 vhCDR3
TGWLGPFDY

SEQ ID NO: 6296 - protein, 12 aa, Artificial Sequence
  Description of Artificial Sequence: Synthetic peptide
  XENP019911 vlCDR1
RASQSVTSSYLA

SEQ ID NO: 6297 - protein, 7 aa, Artificial Sequence
  Description of Artificial Sequence: Synthetic peptide
  XENP019911 vlCDR2
GAFSRAT

SEQ ID NO: 6298 - protein, 9 aa, Artificial Sequence
  Description of Artificial Sequence: Synthetic peptide
  XENP019911 vlCDR3
QQYGSSPWT

SEQ ID NO: 6299 - protein, 246 aa, Artificial Sequence
  Description of Artificial Sequence: Synthetic polypeptide
  XENP019912 [CTLA-4]_H0_L0.24_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 6300 - protein, 118 aa, Artificial Sequence; identical to SEQ ID NO: 3737
  Description of Artificial Sequence: Synthetic polypeptide
  VH of XENP019912

SEQ ID NO: 6301 - protein, 108 aa, Artificial Sequence
  Description of Artificial Sequence: Synthetic polypeptide
  VL of XENP019912
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 6302 - protein, 5 aa, Artificial Sequence
  Description of Artificial Sequence: Synthetic peptide
  XENP019912 vhCDR1
SYTMH

SEQ ID NO: 6303 - protein, 17 aa, Artificial Sequence
  Description of Artificial Sequence: Synthetic peptide
  XENP019912 vhCDR2
FISYDGNNKYYADSVKG

SEQ ID NO: 6304 - protein, 9 aa, Artificial Sequence
  Description of Artificial Sequence: Synthetic peptide
  XENP019912 vhCDR3
TGWLGPFDY

SEQ ID NO: 6305 - protein, 12 aa, Artificial Sequence
  Description of Artificial Sequence: Synthetic peptide
  XENP019912 vlCDR1
RASQSVGASYLA

SEQ ID NO: 6306 - protein, 7 aa, Artificial Sequence
  Description of Artificial Sequence: Synthetic peptide
  XENP019912 vlCDR2
GAFSRAT

SEQ ID NO: 6307 - protein, 9 aa, Artificial Sequence
  Description of Artificial Sequence: Synthetic peptide
  XENP019912 vlCDR3
QQYGSSPWT

SEQ ID NO: 6308 - protein, 246 aa, Artificial Sequence
  Description of Artificial Sequence: Synthetic polypeptide
  XENP019913 [CTLA-4]_H0_L0.25_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 6309 - protein, 118 aa, Artificial Sequence; identical to SEQ ID NO: 3737
  Description of Artificial Sequence: Synthetic polypeptide
  VH of XENP019913

SEQ ID NO: 6310 - protein, 108 aa, Artificial Sequence
  Description of Artificial Sequence: Synthetic polypeptide
  VL of XENP019913
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 6311 - protein, 5 aa, Artificial Sequence
  Description of Artificial Sequence: Synthetic peptide
  XENP019913 vhCDR1
SYTMH

SEQ ID NO: 6312 - protein, 17 aa, Artificial Sequence
  Description of Artificial Sequence: Synthetic peptide
  XENP019913 vhCDR2
FISYDGNNKYYADSVKG

SEQ ID NO: 6313 - protein, 9 aa, Artificial Sequence
  Description of Artificial Sequence: Synthetic peptide
  XENP019913 vhCDR3
TGWLGPFDY

SEQ ID NO: 6314 - protein, 12 aa, Artificial Sequence
  Description of Artificial Sequence: Synthetic peptide
  XENP019913 vlCDR1
RASQSVGGSYLA

SEQ ID NO: 6315 - protein, 7 aa, Artificial Sequence
  Description of Artificial Sequence: Synthetic peptide
  XENP019913 vlCDR2
GAFSRAT

SEQ ID NO: 6316 - protein, 9 aa, Artificial Sequence
  Description of Artificial Sequence: Synthetic peptide
  XENP019913 vlCDR3
QQYGSSPWT

SEQ ID NO: 6317 - protein, 246 aa, Artificial Sequence
  Description of Artificial Sequence: Synthetic polypeptide
  XENP019914 [CTLA-4]_H0_L0.26_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 6318 - protein, 118 aa, Artificial Sequence; identical to SEQ ID NO: 3737
  Description of Artificial Sequence: Synthetic polypeptide
  VH of XENP019914

SEQ ID NO: 6319 - protein, 108 aa, Artificial Sequence
  Description of Artificial Sequence: Synthetic polypeptide
  VL of XENP019914
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 6320 - protein, 5 aa, Artificial Sequence
  Description of Artificial Sequence: Synthetic peptide
  XENP019914 vhCDR1
SYTMH

SEQ ID NO: 6321 - protein, 17 aa, Artificial Sequence
  Description of Artificial Sequence: Synthetic peptide
  XENP019914 vhCDR2
FISYDGNNKYYADSVKG

SEQ ID NO: 6322 - protein, 9 aa, Artificial Sequence
  Description of Artificial Sequence: Synthetic peptide
  XENP019914 vhCDR3
TGWLGPFDY

SEQ ID NO: 6323 - protein, 12 aa, Artificial Sequence
  Description of Artificial Sequence: Synthetic peptide
  XENP019914 vlCDR1
RASQSVGNSYLA

SEQ ID NO: 6324 - protein, 7 aa, Artificial Sequence
  Description of Artificial Sequence: Synthetic peptide
  XENP019914 vlCDR2
GAFSRAT

SEQ ID NO: 6325 - protein, 9 aa, Artificial Sequence
  Description of Artificial Sequence: Synthetic peptide
  XENP019914 vlCDR3
QQYGSSPWT

SEQ ID NO: 6326 - protein, 246 aa, Artificial Sequence
  Description of Artificial Sequence: Synthetic polypeptide
  XENP019915 [CTLA-4]_H0_L0.27_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 6327 - protein, 118 aa, Artificial Sequence; identical to SEQ ID NO: 3737
  Description of Artificial Sequence: Synthetic polypeptide
  VH of XENP019915

SEQ ID NO: 6328 - protein, 108 aa, Artificial Sequence
  Description of Artificial Sequence: Synthetic polypeptide
  VL of XENP019915
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 6329 - protein, 5 aa, Artificial Sequence
  Description of Artificial Sequence: Synthetic peptide
  XENP019915 vhCDR1
SYTMH

SEQ ID NO: 6330 - protein, 17 aa, Artificial Sequence
  Description of Artificial Sequence: Synthetic peptide
  XENP019915 vhCDR2
FISYDGNNKYYADSVKG

SEQ ID NO: 6331 - protein, 9 aa, Artificial Sequence
  Description of Artificial Sequence: Synthetic peptide
  XENP019915 vhCDR3
TGWLGPFDY

SEQ ID NO: 6332 - protein, 12 aa, Artificial Sequence
  Description of Artificial Sequence: Synthetic peptide
  XENP019915 vlCDR1
RASQSVGQSYLA

SEQ ID NO: 6333 - protein, 7 aa, Artificial Sequence
  Description of Artificial Sequence: Synthetic peptide
  XENP019915 vlCDR2
GAFSRAT

SEQ ID NO: 6334 - protein, 9 aa, Artificial Sequence
  Description of Artificial Sequence: Synthetic peptide
  XENP019915 vlCDR3
QQYGSSPWT

SEQ ID NO: 6335 - protein, 246 aa, Artificial Sequence
  Description of Artificial Sequence: Synthetic polypeptide
  XENP019916 [CTLA-4]_H0_L0.28_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 6336 - protein, 118 aa, Artificial Sequence; identical to SEQ ID NO: 3737
  Description of Artificial Sequence: Synthetic polypeptide
  VH of XENP019916

SEQ ID NO: 6337 - protein, 108 aa, Artificial Sequence
  Description of Artificial Sequence: Synthetic polypeptide
  VL of XENP019916
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 6338 - protein, 5 aa, Artificial Sequence
  Description of Artificial Sequence: Synthetic peptide
  XENP019916 vhCDR1
SYTMH

SEQ ID NO: 6339 - protein, 17 aa, Artificial Sequence
  Description of Artificial Sequence: Synthetic peptide
  XENP019916 vhCDR2
FISYDGNNKYYADSVKG

SEQ ID NO: 6340 - protein, 9 aa, Artificial Sequence
  Description of Artificial Sequence: Synthetic peptide
  XENP019916 vhCDR3
TGWLGPFDY

SEQ ID NO: 6341 - protein, 12 aa, Artificial Sequence
  Description of Artificial Sequence: Synthetic peptide
  XENP019916 vlCDR1
RASQSVGTSYLA

SEQ ID NO: 6342 - protein, 7 aa, Artificial Sequence
  Description of Artificial Sequence: Synthetic peptide
  XENP019916 vlCDR2
GAFSRAT

SEQ ID NO: 6343 - protein, 9 aa, Artificial Sequence
  Description of Artificial Sequence: Synthetic peptide
  XENP019916 vlCDR3
QQYGSSPWT

SEQ ID NO: 6344 - protein, 246 aa, Artificial Sequence
  Description of Artificial Sequence: Synthetic polypeptide
  XENP019917 [CTLA-4]_H0_L0.29_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 6345 - protein, 118 aa, Artificial Sequence; identical to SEQ ID NO: 3737
  Description of Artificial Sequence: Synthetic polypeptide
  VH of XENP019917

SEQ ID NO: 6346 - protein, 108 aa, Artificial Sequence
  Description of Artificial Sequence: Synthetic polypeptide
  VL of XENP019917
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 6347 - protein, 5 aa, Artificial Sequence
  Description of Artificial Sequence: Synthetic peptide
  XENP019917 vhCDR1
SYTMH

SEQ ID NO: 6348 - protein, 17 aa, Artificial Sequence
  Description of Artificial Sequence: Synthetic peptide
  XENP019917 vhCDR2
FISYDGNNKYYADSVKG

SEQ ID NO: 6349 - protein, 9 aa, Artificial Sequence
  Description of Artificial Sequence: Synthetic peptide
  XENP019917 vhCDR3
TGWLGPFDY

SEQ ID NO: 6350 - protein, 12 aa, Artificial Sequence
  Description of Artificial Sequence: Synthetic peptide
  XENP019917 vlCDR1
RASQSVGSAYLA

SEQ ID NO: 6351 - protein, 7 aa, Artificial Sequence
  Description of Artificial Sequence: Synthetic peptide
  XENP019917 vlCDR2
GAFSRAT

SEQ ID NO: 6352 - protein, 9 aa, Artificial Sequence
  Description of Artificial Sequence: Synthetic peptide
  XENP019917 vlCDR3
QQYGSSPWT

SEQ ID NO: 6353 - protein, 246 aa, Artificial Sequence
  Description of Artificial Sequence: Synthetic polypeptide
  XENP019918 [CTLA-4]_H0_L0.30_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 6354 - protein, 118 aa, Artificial Sequence; identical to SEQ ID NO: 3737
  Description of Artificial Sequence: Synthetic polypeptide
  VH of XENP019918

SEQ ID NO: 6355 - protein, 108 aa, Artificial Sequence
  Description of Artificial Sequence: Synthetic polypeptide
  VL of XENP019918
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 6356 - protein, 5 aa, Artificial Sequence
  Description of Artificial Sequence: Synthetic peptide
  XENP019918 vhCDR1
SYTMH

SEQ ID NO: 6357 - protein, 17 aa, Artificial Sequence
  Description of Artificial Sequence: Synthetic peptide
  XENP019918 vhCDR2
FISYDGNNKYYADSVKG

SEQ ID NO: 6358 - protein, 9 aa, Artificial Sequence
  Description of Artificial Sequence: Synthetic peptide
  XENP019918 vhCDR3
TGWLGPFDY

SEQ ID NO: 6359 - protein, 12 aa, Artificial Sequence
  Description of Artificial Sequence: Synthetic peptide
  XENP019918 vlCDR1
RASQSVGSGYLA

SEQ ID NO: 6360 - protein, 7 aa, Artificial Sequence
  Description of Artificial Sequence: Synthetic peptide
  XENP019918 vlCDR2
GAFSRAT

SEQ ID NO: 6361 - protein, 9 aa, Artificial Sequence
  Description of Artificial Sequence: Synthetic peptide
  XENP019918 vlCDR3
QQYGSSPWT

SEQ ID NO: 6362 - protein, 246 aa, Artificial Sequence
  Description of Artificial Sequence: Synthetic polypeptide
  XENP019919 [CTLA-4]_H0_L0.31_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 6363 - protein, 118 aa, Artificial Sequence; identical to SEQ ID NO: 3737
  Description of Artificial Sequence: Synthetic polypeptide
  VH of XENP019919

SEQ ID NO: 6364 - protein, 108 aa, Artificial Sequence
  Description of Artificial Sequence: Synthetic polypeptide
  VL of XENP019919
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 6365 - protein, 5 aa, Artificial Sequence
  Description of Artificial Sequence: Synthetic peptide
  XENP019919 vhCDR1
SYTMH

SEQ ID NO: 6366 - protein, 17 aa, Artificial Sequence
  Description of Artificial Sequence: Synthetic peptide
  XENP019919 vhCDR2
FISYDGNNKYYADSVKG

SEQ ID NO: 6367 - protein, 9 aa, Artificial Sequence
  Description of Artificial Sequence: Synthetic peptide
  XENP019919 vhCDR3
TGWLGPFDY

SEQ ID NO: 6368 - protein, 12 aa, Artificial Sequence
  Description of Artificial Sequence: Synthetic peptide
  XENP019919 vlCDR1
RASQSVGSNYLA

SEQ ID NO: 6369 - protein, 7 aa, Artificial Sequence
  Description of Artificial Sequence: Synthetic peptide
  XENP019919 vlCDR2
GAFSRAT

SEQ ID NO: 6370 - protein, 9 aa, Artificial Sequence
  Description of Artificial Sequence: Synthetic peptide
  XENP019919 vlCDR3
QQYGSSPWT

SEQ ID NO: 6371 - protein, 246 aa, Artificial Sequence
  Description of Artificial Sequence: Synthetic polypeptide
  XENP019920 [CTLA-4]_H0_L0.32_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 6372 - protein, 118 aa, Artificial Sequence; identical to SEQ ID NO: 3737
  Description of Artificial Sequence: Synthetic polypeptide
  VH of XENP019920

SEQ ID NO: 6373 - protein, 108 aa, Artificial Sequence
  Description of Artificial Sequence: Synthetic polypeptide
  VL of XENP019920
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 6374 - protein, 5 aa, Artificial Sequence
  Description of Artificial Sequence: Synthetic peptide
  XENP019920 vhCDR1
SYTMH

SEQ ID NO: 6375 - protein, 17 aa, Artificial Sequence
  Description of Artificial Sequence: Synthetic peptide
  XENP019920 vhCDR2
FISYDGNNKYYADSVKG

SEQ ID NO: 6376 - protein, 9 aa, Artificial Sequence
  Description of Artificial Sequence: Synthetic peptide
  XENP019920 vhCDR3
TGWLGPFDY

SEQ ID NO: 6377 - protein, 12 aa, Artificial Sequence
  Description of Artificial Sequence: Synthetic peptide
  XENP019920 vlCDR1
RASQSVGSQYLA

SEQ ID NO: 6378 - protein, 7 aa, Artificial Sequence
  Description of Artificial Sequence: Synthetic peptide
  XENP019920 vlCDR2
GAFSRAT

SEQ ID NO: 6379 - protein, 9 aa, Artificial Sequence
  Description of Artificial Sequence: Synthetic peptide
  XENP019920 vlCDR3
QQYGSSPWT

SEQ ID NO: 6380 - protein, 246 aa, Artificial Sequence
  Description of Artificial Sequence: Synthetic polypeptide
  XENP019921 [CTLA-4]_H0_L0.33_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 6381 - protein, 118 aa, Artificial Sequence; identical to SEQ ID NO: 3737
  Description of Artificial Sequence: Synthetic polypeptide
  VH of XENP019921

SEQ ID NO: 6382 - protein, 108 aa, Artificial Sequence
  Description of Artificial Sequence: Synthetic polypeptide
  VL of XENP019921
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 6383 - protein, 5 aa, Artificial Sequence
  Description of Artificial Sequence: Synthetic peptide
  XENP019921 vhCDR1
SYTMH

SEQ ID NO: 6384 - protein, 17 aa, Artificial Sequence
  Description of Artificial Sequence: Synthetic peptide
  XENP019921 vhCDR2
FISYDGNNKYYADSVKG

SEQ ID NO: 6385 - protein, 9 aa, Artificial Sequence
  Description of Artificial Sequence: Synthetic peptide
  XENP019921 vhCDR3
TGWLGPFDY

SEQ ID NO: 6386 - protein, 12 aa, Artificial Sequence
  Description of Artificial Sequence: Synthetic peptide
  XENP019921 vlCDR1
RASQSVGSTYLA

SEQ ID NO: 6387 - protein, 7 aa, Artificial Sequence
  Description of Artificial Sequence: Synthetic peptide
  XENP019921 vlCDR2
GAFSRAT

SEQ ID NO: 6388 - protein, 9 aa, Artificial Sequence
  Description of Artificial Sequence: Synthetic peptide
  XENP019921 vlCDR3
QQYGSSPWT

SEQ ID NO: 6389 - protein, 246 aa, Artificial Sequence
  Description of Artificial Sequence: Synthetic polypeptide
  XENP019922 [CTLA-4]_H0_L0.34_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 6390 - protein, 118 aa, Artificial Sequence; identical to SEQ ID NO: 3737
  Description of Artificial Sequence: Synthetic polypeptide
  VH of XENP019922

SEQ ID NO: 6391 - protein, 108 aa, Artificial Sequence
  Description of Artificial Sequence: Synthetic polypeptide
  VL of XENP019922
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 6392 - protein, 5 aa, Artificial Sequence
  Description of Artificial Sequence: Synthetic peptide
  XENP019922 vhCDR1
SYTMH

SEQ ID NO: 6393 - protein, 17 aa, Artificial Sequence
  Description of Artificial Sequence: Synthetic peptide
  XENP019922 vhCDR2
FISYDGNNKYYADSVKG

SEQ ID NO: 6394 - protein, 9 aa, Artificial Sequence
  Description of Artificial Sequence: Synthetic peptide
  XENP019922 vhCDR3
TGWLGPFDY

SEQ ID NO: 6395 - protein, 12 aa, Artificial Sequence
  Description of Artificial Sequence: Synthetic peptide
  XENP019922 vlCDR1
RASQSVGSSALA

SEQ ID NO: 6396 - protein, 7 aa, Artificial Sequence
  Description of Artificial Sequence: Synthetic peptide
  XENP019922 vlCDR2
GAFSRAT

SEQ ID NO: 6397 - protein, 9 aa, Artificial Sequence
  Description of Artificial Sequence: Synthetic peptide
  XENP019922 vlCDR3
QQYGSSPWT

SEQ ID NO: 6398 - protein, 246 aa, Artificial Sequence
  Description of Artificial Sequence: Synthetic polypeptide
  XENP019923 [CTLA-4]_H0_L0.35_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 6399 - protein, 118 aa, Artificial Sequence; identical to SEQ ID NO: 3737
  Description of Artificial Sequence: Synthetic polypeptide
  VH of XENP019923

SEQ ID NO: 6400 - protein, 108 aa, Artificial Sequence
  Description of Artificial Sequence: Synthetic polypeptide
  VL of XENP019923
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 6401 - protein, 5 aa, Artificial Sequence
  Description of Artificial Sequence: Synthetic peptide
  XENP019923 vhCDR1
SYTMH

SEQ ID NO: 6402 - protein, 17 aa, Artificial Sequence
  Description of Artificial Sequence: Synthetic peptide
  XENP019923 vhCDR2
FISYDGNNKYYADSVKG

SEQ ID NO: 6403 - protein, 9 aa, Artificial Sequence
  Description of Artificial Sequence: Synthetic peptide
  XENP019923 vhCDR3
TGWLGPFDY

SEQ ID NO: 6404 - protein, 12 aa, Artificial Sequence
  Description of Artificial Sequence: Synthetic peptide
  XENP019923 vlCDR1
RASQSVGSSFLA

SEQ ID NO: 6405 - protein, 7 aa, Artificial Sequence
  Description of Artificial Sequence: Synthetic peptide
  XENP019923 vlCDR2
GAFSRAT

SEQ ID NO: 6406 - protein, 9 aa, Artificial Sequence
  Description of Artificial Sequence: Synthetic peptide
  XENP019923 vlCDR3
QQYGSSPWT

SEQ ID NO: 6407 - protein, 246 aa, Artificial Sequence
  Description of Artificial Sequence: Synthetic polypeptide
  XENP019924 [CTLA-4]_H0_L0.36_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 6408 - protein, 118 aa, Artificial Sequence; identical to SEQ ID NO: 3737
  Description of Artificial Sequence: Synthetic polypeptide
  VH of XENP019924

SEQ ID NO: 6409 - protein, 108 aa, Artificial Sequence
  Description of Artificial Sequence: Synthetic polypeptide
  VL of XENP019924
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 6410 - protein, 5 aa, Artificial Sequence
  Description of Artificial Sequence: Synthetic peptide
  XENP019924 vhCDR1
SYTMH

SEQ ID NO: 6411 - protein, 17 aa, Artificial Sequence
  Description of Artificial Sequence: Synthetic peptide
  XENP019924 vhCDR2
FISYDGNNKYYADSVKG

SEQ ID NO: 6412 - protein, 9 aa, Artificial Sequence
  Description of Artificial Sequence: Synthetic peptide
  XENP019924 vhCDR3
TGWLGPFDY

SEQ ID NO: 6413 - protein, 12 aa, Artificial Sequence
  Description of Artificial Sequence: Synthetic peptide
  XENP019924 vlCDR1
RASQSVGSSHLA

SEQ ID NO: 6414 - protein, 7 aa, Artificial Sequence
  Description of Artificial Sequence: Synthetic peptide
  XENP019924 vlCDR2
GAFSRAT

SEQ ID NO: 6415 - protein, 9 aa, Artificial Sequence
  Description of Artificial Sequence: Synthetic peptide
  XENP019924 vlCDR3
QQYGSSPWT

SEQ ID NO: 6416 - protein, 246 aa, Artificial Sequence
  Description of Artificial Sequence: Synthetic polypeptide
  XENP019925 [CTLA-4]_H0_L0.37_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 6417 - protein, 118 aa, Artificial Sequence; identical to SEQ ID NO: 3737
  Description of Artificial Sequence: Synthetic polypeptide
  VH of XENP019925

SEQ ID NO: 6418 - protein, 108 aa, Artificial Sequence
  Description of Artificial Sequence: Synthetic polypeptide
  VL of XENP019925
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 6419 - protein, 5 aa, Artificial Sequence
  Description of Artificial Sequence: Synthetic peptide
  XENP019925 vhCDR1
SYTMH

SEQ ID NO: 6420 - protein, 17 aa, Artificial Sequence
  Description of Artificial Sequence: Synthetic peptide
  XENP019925 vhCDR2
FISYDGNNKYYADSVKG

SEQ ID NO: 6421 - protein, 9 aa, Artificial Sequence
  Description of Artificial Sequence: Synthetic peptide
  XENP019925 vhCDR3
TGWLGPFDY

SEQ ID NO: 6422 - protein, 12 aa, Artificial Sequence
  Description of Artificial Sequence: Synthetic peptide
  XENP019925 vlCDR1
RASQSVGSSLLA

SEQ ID NO: 6423 - protein, 7 aa, Artificial Sequence
  Description of Artificial Sequence: Synthetic peptide
  XENP019925 vlCDR2
GAFSRAT

SEQ ID NO: 6424 - protein, 9 aa, Artificial Sequence
  Description of Artificial Sequence: Synthetic peptide
  XENP019925 vlCDR3
QQYGSSPWT

SEQ ID NO: 6425 - protein, 246 aa, Artificial Sequence
  Description of Artificial Sequence: Synthetic polypeptide
  XENP019926 [CTLA-4]_H0_L0.38_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 6426 - protein, 118 aa, Artificial Sequence; identical to SEQ ID NO: 3737
  Description of Artificial Sequence: Synthetic polypeptide
  VH of XENP019926

SEQ ID NO: 6427 - protein, 108 aa, Artificial Sequence
  Description of Artificial Sequence: Synthetic polypeptide
  VL of XENP019926
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 6428 - protein, 5 aa, Artificial Sequence
  Description of Artificial Sequence: Synthetic peptide
  XENP019926 vhCDR1
SYTMH

SEQ ID NO: 6429 - protein, 17 aa, Artificial Sequence
  Description of Artificial Sequence: Synthetic peptide
  XENP019926 vhCDR2
FISYDGNNKYYADSVKG

SEQ ID NO: 6430 - protein, 9 aa, Artificial Sequence
  Description of Artificial Sequence: Synthetic peptide
  XENP019926 vhCDR3
TGWLGPFDY

SEQ ID NO: 6431 - protein, 12 aa, Artificial Sequence
  Description of Artificial Sequence: Synthetic peptide
  XENP019926 vlCDR1
RASQSVGSSNLA

SEQ ID NO: 6432 - protein, 7 aa, Artificial Sequence
  Description of Artificial Sequence: Synthetic peptide
  XENP019926 vlCDR2
GAFSRAT

SEQ ID NO: 6433 - protein, 9 aa, Artificial Sequence
  Description of Artificial Sequence: Synthetic peptide
  XENP019926 vlCDR3
QQYGSSPWT

SEQ ID NO: 6434 - protein, 246 aa, Artificial Sequence
  Description of Artificial Sequence: Synthetic polypeptide
  XENP019927 [CTLA-4]_H0_L0.39_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 6435 - protein, 118 aa, Artificial Sequence; identical to SEQ ID NO: 3737
  Description of Artificial Sequence: Synthetic polypeptide
  VH of XENP019927

SEQ ID NO: 6436 - protein, 108 aa, Artificial Sequence
  Description of Artificial Sequence: Synthetic polypeptide
  VL of XENP019927
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 6437 - protein, 5 aa, Artificial Sequence
  Description of Artificial Sequence: Synthetic peptide
  XENP019927 vhCDR1
SYTMH

SEQ ID NO: 6438 - protein, 17 aa, Artificial Sequence
  Description of Artificial Sequence: Synthetic peptide
  XENP019927 vhCDR2
FISYDGNNKYYADSVKG

SEQ ID NO: 6439 - protein, 9 aa, Artificial Sequence
  Description of Artificial Sequence: Synthetic peptide
  XENP019927 vhCDR3
TGWLGPFDY

SEQ ID NO: 6440 - protein, 12 aa, Artificial Sequence
  Description of Artificial Sequence: Synthetic peptide
  XENP019927 vlCDR1
RASQSVGSSSLA

SEQ ID NO: 6441 - protein, 7 aa, Artificial Sequence
  Description of Artificial Sequence: Synthetic peptide
  XENP019927 vlCDR2
GAFSRAT

SEQ ID NO: 6442 - protein, 9 aa, Artificial Sequence
  Description of Artificial Sequence: Synthetic peptide
  XENP019927 vlCDR3
QQYGSSPWT

SEQ ID NO: 6443 - protein, 246 aa, Artificial Sequence
  Description of Artificial Sequence: Synthetic polypeptide
  XENP019928 [CTLA-4]_H0_L0.40_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 6444 - protein, 118 aa, Artificial Sequence; identical to SEQ ID NO: 3737
  Description of Artificial Sequence: Synthetic polypeptide
  VH of XENP019928

SEQ ID NO: 6445 - protein, 108 aa, Artificial Sequence
  Description of Artificial Sequence: Synthetic polypeptide
  VL of XENP019928
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 6446 - protein, 5 aa, Artificial Sequence
  Description of Artificial Sequence: Synthetic peptide
  XENP019928 vhCDR1
SYTMH

SEQ ID NO: 6447 - protein, 17 aa, Artificial Sequence
  Description of Artificial Sequence: Synthetic peptide
  XENP019928 vhCDR2
FISYDGNNKYYADSVKG

SEQ ID NO: 6448 - protein, 9 aa, Artificial Sequence
  Description of Artificial Sequence: Synthetic peptide
  XENP019928 vhCDR3
TGWLGPFDY

SEQ ID NO: 6449 - protein, 12 aa, Artificial Sequence
  Description of Artificial Sequence: Synthetic peptide
  XENP019928 vlCDR1
RASQSVGSSVLA

SEQ ID NO: 6450 - protein, 7 aa, Artificial Sequence
  Description of Artificial Sequence: Synthetic peptide
  XENP019928 vlCDR2
GAFSRAT

SEQ ID NO: 6451 - protein, 9 aa, Artificial Sequence
  Description of Artificial Sequence: Synthetic peptide
  XENP019928 vlCDR3
QQYGSSPWT

SEQ ID NO: 6452 - protein, 246 aa, Artificial Sequence
  Description of Artificial Sequence: Synthetic polypeptide
  XENP019929 [CTLA-4]_H0_L0.41_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 6453 - protein, 118 aa, Artificial Sequence; identical to SEQ ID NO: 3737
  Description of Artificial Sequence: Synthetic polypeptide
  VH of XENP019929

SEQ ID NO: 6454 - protein, 108 aa, Artificial Sequence
  Description of Artificial Sequence: Synthetic polypeptide
  VL of XENP019929
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 6455 - protein, 5 aa, Artificial Sequence
  Description of Artificial Sequence: Synthetic peptide
  XENP019929 vhCDR1
SYTMH

SEQ ID NO: 6456 - protein, 17 aa, Artificial Sequence
  Description of Artificial Sequence: Synthetic peptide
  XENP019929 vhCDR2
FISYDGNNKYYADSVKG

SEQ ID NO: 6457 - protein, 9 aa, Artificial Sequence
  Description of Artificial Sequence: Synthetic peptide
  XENP019929 vhCDR3
TGWLGPFDY

SEQ ID NO: 6458 - protein, 12 aa, Artificial Sequence
  Description of Artificial Sequence: Synthetic peptide
  XENP019929 vlCDR1
RASQSVGSSYMA

SEQ ID NO: 6459 - protein, 7 aa, Artificial Sequence
  Description of Artificial Sequence: Synthetic peptide
  XENP019929 vlCDR2
GAFSRAT

SEQ ID NO: 6460 - protein, 9 aa, Artificial Sequence
  Description of Artificial Sequence: Synthetic peptide
  XENP019929 vlCDR3
QQYGSSPWT

SEQ ID NO: 6461 - protein, 246 aa, Artificial Sequence
  Description of Artificial Sequence: Synthetic polypeptide
  XENP019930 [CTLA-4]_H0_L0.42_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 6462 - protein, 118 aa, Artificial Sequence; identical to SEQ ID NO: 3737
  Description of Artificial Sequence: Synthetic polypeptide
  VH of XENP019930

SEQ ID NO: 6463 - protein, 108 aa, Artificial Sequence
  Description of Artificial Sequence: Synthetic polypeptide
  VL of XENP019930
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 6464 - protein, 5 aa, Artificial Sequence
  Description of Artificial Sequence: Synthetic peptide
  XENP019930 vhCDR1
SYTMH

SEQ ID NO: 6465 - protein, 17 aa, Artificial Sequence
  Description of Artificial Sequence: Synthetic peptide
  XENP019930 vhCDR2
FISYDGNNKYYADSVKG

SEQ ID NO: 6466 - protein, 9 aa, Artificial Sequence
  Description of Artificial Sequence: Synthetic peptide
  XENP019930 vhCDR3
TGWLGPFDY

SEQ ID NO: 6467 - protein, 12 aa, Artificial Sequence
  Description of Artificial Sequence: Synthetic peptide
  XENP019930 vlCDR1
RASQSVGSSYLD

SEQ ID NO: 6468 - protein, 7 aa, Artificial Sequence
  Description of Artificial Sequence: Synthetic peptide
  XENP019930 vlCDR2
GAFSRAT

SEQ ID NO: 6469 - protein, 9 aa, Artificial Sequence
  Description of Artificial Sequence: Synthetic peptide
  XENP019930 vlCDR3
QQYGSSPWT

SEQ ID NO: 6470 - protein, 246 aa, Artificial Sequence
  Description of Artificial Sequence: Synthetic polypeptide
  XENP019931 [CTLA-4]_H0_L0.43_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 6471 - protein, 118 aa, Artificial Sequence; identical to SEQ ID NO: 3737
  Description of Artificial Sequence: Synthetic polypeptide
  VH of XENP019931

SEQ ID NO: 6472 - protein, 108 aa, Artificial Sequence
  Description of Artificial Sequence: Synthetic polypeptide
  VL of XENP019931
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 6473 - protein, 5 aa, Artificial Sequence
  Description of Artificial Sequence: Synthetic peptide
  XENP019931 vhCDR1
SYTMH

SEQ ID NO: 6474 - protein, 17 aa, Artificial Sequence
  Description of Artificial Sequence: Synthetic peptide
  XENP019931 vhCDR2
FISYDGNNKYYADSVKG

SEQ ID NO: 6475 - protein, 9 aa, Artificial Sequence
  Description of Artificial Sequence: Synthetic peptide
  XENP019931 vhCDR3
TGWLGPFDY

SEQ ID NO: 6476 - protein, 12 aa, Artificial Sequence
  Description of Artificial Sequence: Synthetic peptide
  XENP019931 vlCDR1
RASQSVGSSYLD

SEQ ID NO: 6477 - protein, 7 aa, Artificial Sequence
  Description of Artificial Sequence: Synthetic peptide
  XENP019931 vlCDR2
GAFSRAT

SEQ ID NO: 6478 - protein, 9 aa, Artificial Sequence
  Description of Artificial Sequence: Synthetic peptide
  XENP019931 vlCDR3
KQYGSSPWT

SEQ ID NO: 6479 - protein, 246 aa, Artificial Sequence
  Description of Artificial Sequence: Synthetic polypeptide
  XENP019932 [CTLA-4]_H0_L0.44_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 6480 - protein, 118 aa, Artificial Sequence; identical to SEQ ID NO: 3737
  Description of Artificial Sequence: Synthetic polypeptide
  VH of XENP019932

SEQ ID NO: 6481 - protein, 108 aa, Artificial Sequence
  Description of Artificial Sequence: Synthetic polypeptide
  VL of XENP019932
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 6482 - protein, 5 aa, Artificial Sequence
  Description of Artificial Sequence: Synthetic peptide
  XENP019932 vhCDR1
SYTMH

SEQ ID NO: 6483 - protein, 17 aa, Artificial Sequence
  Description of Artificial Sequence: Synthetic peptide
  XENP019932 vhCDR2
FISYDGNNKYYADSVKG

SEQ ID NO: 6484 - protein, 9 aa, Artificial Sequence
  Description of Artificial Sequence: Synthetic peptide
  XENP019932 vhCDR3
TGWLGPFDY

SEQ ID NO: 6485 - protein, 12 aa, Artificial Sequence
  Description of Artificial Sequence: Synthetic peptide
  XENP019932 vlCDR1
RASQSVGSSYLS

SEQ ID NO: 6486 - protein, 7 aa, Artificial Sequence
  Description of Artificial Sequence: Synthetic peptide
  XENP019932 vlCDR2
GAFSRAT

SEQ ID NO: 6487 - protein, 9 aa, Artificial Sequence
  Description of Artificial Sequence: Synthetic peptide
  XENP019932 vlCDR3
QQYGSSPWT

SEQ ID NO: 6488 - protein, 246 aa, Artificial Sequence
  Description of Artificial Sequence: Synthetic polypeptide
  XENP019933 [CTLA-4]_H0_L0.45_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 6489 - protein, 118 aa, Artificial Sequence; identical to SEQ ID NO: 3737
  Description of Artificial Sequence: Synthetic polypeptide
  VH of XENP019933

SEQ ID NO: 6490 - protein, 108 aa, Artificial Sequence
  Description of Artificial Sequence: Synthetic polypeptide
  VL of XENP019933
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 6491 - protein, 5 aa, Artificial Sequence
  Description of Artificial Sequence: Synthetic peptide
  XENP019933 vhCDR1
SYTMH

SEQ ID NO: 6492 - protein, 17 aa, Artificial Sequence
  Description of Artificial Sequence: Synthetic peptide
  XENP019933 vhCDR2
FISYDGNNKYYADSVKG

SEQ ID NO: 6493 - protein, 9 aa, Artificial Sequence
  Description of Artificial Sequence: Synthetic peptide
  XENP019933 vhCDR3
TGWLGPFDY

SEQ ID NO: 6494 - protein, 12 aa, Artificial Sequence
  Description of Artificial Sequence: Synthetic peptide
  XENP019933 vlCDR1
RASQSVGSSYLT

SEQ ID NO: 6495 - protein, 7 aa, Artificial Sequence
  Description of Artificial Sequence: Synthetic peptide
  XENP019933 vlCDR2
GAFSRAT

SEQ ID NO: 6496 - protein, 9 aa, Artificial Sequence
  Description of Artificial Sequence: Synthetic peptide
  XENP019933 vlCDR3
QQYGSSPWT

SEQ ID NO: 6497 - protein, 246 aa, Artificial Sequence
  Description of Artificial Sequence: Synthetic polypeptide
  XENP019934 [CTLA-4]_H0_L0.46_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 6498 - protein, 118 aa, Artificial Sequence; identical to SEQ ID NO: 3737
  Description of Artificial Sequence: Synthetic polypeptide
  VH of XENP019934

SEQ ID NO: 6499 - protein, 108 aa, Artificial Sequence
  Description of Artificial Sequence: Synthetic polypeptide
  VL of XENP019934
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 6500 - protein, 5 aa, Artificial Sequence
  Description of Artificial Sequence: Synthetic peptide
  XENP019934 vhCDR1
SYTMH

SEQ ID NO: 6501 - protein, 17 aa, Artificial Sequence
  Description of Artificial Sequence: Synthetic peptide
  XENP019934 vhCDR2
FISYDGNNKYYADSVKG

SEQ ID NO: 6502 - protein, 9 aa, Artificial Sequence
  Description of Artificial Sequence: Synthetic peptide
  XENP019934 vhCDR3
TGWLGPFDY

SEQ ID NO: 6503 - protein, 12 aa, Artificial Sequence
  Description of Artificial Sequence: Synthetic peptide
  XENP019934 vlCDR1
RASQSVGSSYLA

SEQ ID NO: 6504 - protein, 7 aa, Artificial Sequence
  Description of Artificial Sequence: Synthetic peptide
  XENP019934 vlCDR2
GAFSRAT

SEQ ID NO: 6505 - protein, 9 aa, Artificial Sequence
  Description of Artificial Sequence: Synthetic peptide
  XENP019934 vlCDR3
QQYGSSPWT

SEQ ID NO: 6506 - protein, 246 aa, Artificial Sequence
  Description of Artificial Sequence: Synthetic polypeptide
  XENP019935 [CTLA-4]_H0_L0.47_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 6507 - protein, 118 aa, Artificial Sequence; identical to SEQ ID NO: 3737
  Description of Artificial Sequence: Synthetic polypeptide
  VH of XENP019935

SEQ ID NO: 6508 - protein, 108 aa, Artificial Sequence
  Description of Artificial Sequence: Synthetic polypeptide
  VL of XENP019935
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 6509 - protein, 5 aa, Artificial Sequence
  Description of Artificial Sequence: Synthetic peptide
  XENP019935 vhCDR1
SYTMH

SEQ ID NO: 6510 - protein, 17 aa, Artificial Sequence
  Description of Artificial Sequence: Synthetic peptide
  XENP019935 vhCDR2
FISYDGNNKYYADSVKG

SEQ ID NO: 6511 - protein, 9 aa, Artificial Sequence
  Description of Artificial Sequence: Synthetic peptide
  XENP019935 vhCDR3
TGWLGPFDY

SEQ ID NO: 6512 - protein, 12 aa, Artificial Sequence
  Description of Artificial Sequence: Synthetic peptide
  XENP019935 vlCDR1
RASQSVGSSYLA

SEQ ID NO: 6513 - protein, 7 aa, Artificial Sequence
  Description of Artificial Sequence: Synthetic peptide
  XENP019935 vlCDR2
GAFSRAT

SEQ ID NO: 6514 - protein, 9 aa, Artificial Sequence
  Description of Artificial Sequence: Synthetic peptide
  XENP019935 vlCDR3
QQYGSSPWT

SEQ ID NO: 6515 - protein, 246 aa, Artificial Sequence
  Description of Artificial Sequence: Synthetic polypeptide
  XENP019936 [CTLA-4]_H0_L0.48_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 6516 - protein, 118 aa, Artificial Sequence; identical to SEQ ID NO: 3737
  Description of Artificial Sequence: Synthetic polypeptide
  VH of XENP019936

SEQ ID NO: 6517 - protein, 108 aa, Artificial Sequence
  Description of Artificial Sequence: Synthetic polypeptide
  VL of XENP019936
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 6518 - protein, 5 aa, Artificial Sequence
  Description of Artificial Sequence: Synthetic peptide
  XENP019936 vhCDR1
SYTMH

SEQ ID NO: 6519 - protein, 17 aa, Artificial Sequence
  Description of Artificial Sequence: Synthetic peptide
  XENP019936 vhCDR2
FISYDGNNKYYADSVKG

SEQ ID NO: 6520 - protein, 9 aa, Artificial Sequence
  Description of Artificial Sequence: Synthetic peptide
  XENP019936 vhCDR3
TGWLGPFDY

SEQ ID NO: 6521 - protein, 12 aa, Artificial Sequence
  Description of Artificial Sequence: Synthetic peptide
  XENP019936 vlCDR1
RASQSVGSSYLA

SEQ ID NO: 6522 - protein, 7 aa, Artificial Sequence
  Description of Artificial Sequence: Synthetic peptide
  XENP019936 vlCDR2
GAFSRAT

SEQ ID NO: 6523 - protein, 9 aa, Artificial Sequence
  Description of Artificial Sequence: Synthetic peptide
  XENP019936 vlCDR3
QQYGSSPWT

SEQ ID NO: 6524 - protein, 246 aa, Artificial Sequence
  Description of Artificial Sequence: Synthetic polypeptide
  XENP019937 [CTLA-4]_H0_L0.49_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 6525 - protein, 118 aa, Artificial Sequence; identical to SEQ ID NO: 3737
  Description of Artificial Sequence: Synthetic polypeptide
  VH of XENP019937

SEQ ID NO: 6526 - protein, 108 aa, Artificial Sequence
  Description of Artificial Sequence: Synthetic polypeptide
  VL of XENP019937
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 6527 - protein, 5 aa, Artificial Sequence
  Description of Artificial Sequence: Synthetic peptide
  XENP019937 vhCDR1
SYTMH

SEQ ID NO: 6528 - protein, 17 aa, Artificial Sequence
  Description of Artificial Sequence: Synthetic peptide
  XENP019937 vhCDR2
FISYDGNNKYYADSVKG

SEQ ID NO: 6529 - protein, 9 aa, Artificial Sequence
  Description of Artificial Sequence: Synthetic peptide
  XENP019937 vhCDR3
TGWLGPFDY

SEQ ID NO: 6530 - protein, 12 aa, Artificial Sequence
  Description of Artificial Sequence: Synthetic peptide
  XENP019937 vlCDR1
RASQSVGSSYLA

SEQ ID NO: 6531 - protein, 7 aa, Artificial Sequence
  Description of Artificial Sequence: Synthetic peptide
  XENP019937 vlCDR2
GAFSRAT

SEQ ID NO: 6532 - protein, 9 aa, Artificial Sequence
  Description of Artificial Sequence: Synthetic peptide
  XENP019937 vlCDR3
QQYGSSPWT

SEQ ID NO: 6533 - protein, 246 aa, Artificial Sequence
  Description of Artificial Sequence: Synthetic polypeptide
  XENP019938 [CTLA-4]_H0_L0.50_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 6534 - protein, 118 aa, Artificial Sequence; identical to SEQ ID NO: 3737
  Description of Artificial Sequence: Synthetic polypeptide
  VH of XENP019938

SEQ ID NO: 6535 - protein, 108 aa, Artificial Sequence; identical to SEQ ID NO: 4708
  Description of Artificial Sequence: Synthetic polypeptide
  VL of XENP019938

SEQ ID NO: 6536 - protein, 5 aa, Artificial Sequence
  Description of Artificial Sequence: Synthetic peptide
  XENP019938 vhCDR1
SYTMH

SEQ ID NO: 6537 - protein, 17 aa, Artificial Sequence
  Description of Artificial Sequence: Synthetic peptide
  XENP019938 vhCDR2
FISYDGNNKYYADSVKG

SEQ ID NO: 6538 - protein, 9 aa, Artificial Sequence
  Description of Artificial Sequence: Synthetic peptide
  XENP019938 vhCDR3
TGWLGPFDY

SEQ ID NO: 6539 - protein, 12 aa, Artificial Sequence
  Description of Artificial Sequence: Synthetic peptide
  XENP019938 vlCDR1
RASQSVGSSYLA

SEQ ID NO: 6540 - protein, 7 aa, Artificial Sequence
  Description of Artificial Sequence: Synthetic peptide
  XENP019938 vlCDR2
GAFSRAT

SEQ ID NO: 6541 - protein, 9 aa, Artificial Sequence
  Description of Artificial Sequence: Synthetic peptide
  XENP019938 vlCDR3
QQYGSSPWT

SEQ ID NO: 6542 - protein, 246 aa, Artificial Sequence
  Description of Artificial Sequence: Synthetic polypeptide
  XENP019939 [CTLA-4]_H0_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 6543 - protein, 118 aa, Artificial Sequence; identical to SEQ ID NO: 3737
  Description of Artificial Sequence: Synthetic polypeptide
  VH of XENP019939

SEQ ID NO: 6544 - protein, 108 aa, Artificial Sequence; identical to SEQ ID NO: 4717
  Description of Artificial Sequence: Synthetic polypeptide
  VL of XENP019939

SEQ ID NO: 6545 - protein, 5 aa, Artificial Sequence
  Description of Artificial Sequence: Synthetic peptide
  XENP019939 vhCDR1
SYTMH

SEQ ID NO: 6546 - protein, 17 aa, Artificial Sequence
  Description of Artificial Sequence: Synthetic peptide
  XENP019939 vhCDR2
FISYDGNNKYYADSVKG

SEQ ID NO: 6547 - protein, 9 aa, Artificial Sequence
  Description of Artificial Sequence: Synthetic peptide
  XENP019939 vhCDR3
TGWLGPFDY

SEQ ID NO: 6548 - protein, 12 aa, Artificial Sequence
  Description of Artificial Sequence: Synthetic peptide
  XENP019939 vlCDR1
RASQSVGSSYLA

SEQ ID NO: 6549 - protein, 7 aa, Artificial Sequence
  Description of Artificial Sequence: Synthetic peptide
  XENP019939 vlCDR2
GAFSRAT

SEQ ID NO: 6550 - protein, 9 aa, Artificial Sequence
  Description of Artificial Sequence: Synthetic peptide
  XENP019939 vlCDR3
QQYGSSPWT

SEQ ID NO: 6551 - protein, 246 aa, Artificial Sequence
  Description of Artificial Sequence: Synthetic polypeptide
  XENP019940 [CTLA-4]_H0_L0.52_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 6552 - protein, 118 aa, Artificial Sequence; identical to SEQ ID NO: 3737
  Description of Artificial Sequence: Synthetic polypeptide
  VH of XENP019940

SEQ ID NO: 6553 - protein, 108 aa, Artificial Sequence
  Description of Artificial Sequence: Synthetic polypeptide
  VL of XENP019940
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 6554 - protein, 5 aa, Artificial Sequence
  Description of Artificial Sequence: Synthetic peptide
  XENP019940 vhCDR1
SYTMH

SEQ ID NO: 6555 - protein, 17 aa, Artificial Sequence
  Description of Artificial Sequence: Synthetic peptide
  XENP019940 vhCDR2
FISYDGNNKYYADSVKG

SEQ ID NO: 6556 - protein, 9 aa, Artificial Sequence
  Description of Artificial Sequence: Synthetic peptide
  XENP019940 vhCDR3
TGWLGPFDY

SEQ ID NO: 6557 - protein, 12 aa, Artificial Sequence
  Description of Artificial Sequence: Synthetic peptide
  XENP019940 vlCDR1
RASQSVGSSYLA

SEQ ID NO: 6558 - protein, 7 aa, Artificial Sequence
  Description of Artificial Sequence: Synthetic peptide
  XENP019940 vlCDR2
GAFSRAT

SEQ ID NO: 6559 - protein, 9 aa, Artificial Sequence
  Description of Artificial Sequence: Synthetic peptide
  XENP019940 vlCDR3
QQYGSSPWT

SEQ ID NO: 6560 - protein, 246 aa, Artificial Sequence
  Description of Artificial Sequence: Synthetic polypeptide
  XENP019941 [CTLA-4]_H0_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 6561 - protein, 118 aa, Artificial Sequence; identical to SEQ ID NO: 3737
  Description of Artificial Sequence: Synthetic polypeptide
  VH of XENP019941

SEQ ID NO: 6562 - protein, 108 aa, Artificial Sequence; identical to SEQ ID NO: 4753
  Description of Artificial Sequence: Synthetic polypeptide
  VL of XENP019941

SEQ ID NO: 6563 - protein, 5 aa, Artificial Sequence
  Description of Artificial Sequence: Synthetic peptide
  XENP019941 vhCDR1
SYTMH

SEQ ID NO: 6564 - protein, 17 aa, Artificial Sequence
  Description of Artificial Sequence: Synthetic peptide
  XENP019941 vhCDR2
FISYDGNNKYYADSVKG

SEQ ID NO: 6565 - protein, 9 aa, Artificial Sequence
  Description of Artificial Sequence: Synthetic peptide
  XENP019941 vhCDR3
TGWLGPFDY

SEQ ID NO: 6566 - protein, 12 aa, Artificial Sequence
  Description of Artificial Sequence: Synthetic peptide
  XENP019941 vlCDR1
RASQSVGSSYLA

SEQ ID NO: 6567 - protein, 7 aa, Artificial Sequence
  Description of Artificial Sequence: Synthetic peptide
  XENP019941 vlCDR2
GAFSRAT

SEQ ID NO: 6568 - protein, 9 aa, Artificial Sequence
  Description of Artificial Sequence: Synthetic peptide
  XENP019941 vlCDR3
QQYGSSPWT

SEQ ID NO: 6569 - protein, 246 aa, Artificial Sequence
  Description of Artificial Sequence: Synthetic polypeptide
  XENP019942 [CTLA-4]_H0_L0.54_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 6570 - protein, 118 aa, Artificial Sequence; identical to SEQ ID NO: 3737
  Description of Artificial Sequence: Synthetic polypeptide
  VH of XENP019942

SEQ ID NO: 6571 - protein, 108 aa, Artificial Sequence
  Description of Artificial Sequence: Synthetic polypeptide
  VL of XENP019942
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 6572 - protein, 5 aa, Artificial Sequence
  Description of Artificial Sequence: Synthetic peptide
  XENP019942 vhCDR1
SYTMH

SEQ ID NO: 6573 - protein, 17 aa, Artificial Sequence
  Description of Artificial Sequence: Synthetic peptide
  XENP019942 vhCDR2
FISYDGNNKYYADSVKG

SEQ ID NO: 6574 - protein, 9 aa, Artificial Sequence
  Description of Artificial Sequence: Synthetic peptide
  XENP019942 vhCDR3
TGWLGPFDY

SEQ ID NO: 6575 - protein, 12 aa, Artificial Sequence
  Description of Artificial Sequence: Synthetic peptide
  XENP019942 vlCDR1
RASQSVGSSYLA

SEQ ID NO: 6576 - protein, 7 aa, Artificial Sequence
  Description of Artificial Sequence: Synthetic peptide
  XENP019942 vlCDR2
GAFSRAT

SEQ ID NO: 6577 - protein, 9 aa, Artificial Sequence
  Description of Artificial Sequence: Synthetic peptide
  XENP019942 vlCDR3
QQYGSSPWT

SEQ ID NO: 6578 - protein, 246 aa, Artificial Sequence
  Description of Artificial Sequence: Synthetic polypeptide
  XENP019943 [CTLA-4]_H0_L0.55_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 6579 - protein, 118 aa, Artificial Sequence; identical to SEQ ID NO: 3737
  Description of Artificial Sequence: Synthetic polypeptide
  VH of XENP019943

SEQ ID NO: 6580 - protein, 108 aa, Artificial Sequence
  Description of Artificial Sequence: Synthetic polypeptide
  VL of XENP019943
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 6581 - protein, 5 aa, Artificial Sequence
  Description of Artificial Sequence: Synthetic peptide
  XENP019943 vhCDR1
SYTMH

SEQ ID NO: 6582 - protein, 17 aa, Artificial Sequence
  Description of Artificial Sequence: Synthetic peptide
  XENP019943 vhCDR2
FISYDGNNKYYADSVKG

SEQ ID NO: 6583 - protein, 9 aa, Artificial Sequence
  Description of Artificial Sequence: Synthetic peptide
  XENP019943 vhCDR3
TGWLGPFDY

SEQ ID NO: 6584 - protein, 12 aa, Artificial Sequence
  Description of Artificial Sequence: Synthetic peptide
  XENP019943 vlCDR1
RASQSVGSSYLA

SEQ ID NO: 6585 - protein, 7 aa, Artificial Sequence
  Description of Artificial Sequence: Synthetic peptide
  XENP019943 vlCDR2
GAFSRAT

SEQ ID NO: 6586 - protein, 9 aa, Artificial Sequence
  Description of Artificial Sequence: Synthetic peptide
  XENP019943 vlCDR3
QQYGSSPWT

SEQ ID NO: 6587 - protein, 246 aa, Artificial Sequence
  Description of Artificial Sequence: Synthetic polypeptide
  XENP019944 [CTLA-4]_H0_L0.56_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 6588 - protein, 118 aa, Artificial Sequence; identical to SEQ ID NO: 3737
  Description of Artificial Sequence: Synthetic polypeptide
  VH of XENP019944

SEQ ID NO: 6589 - protein, 108 aa, Artificial Sequence
  Description of Artificial Sequence: Synthetic polypeptide
  VL of XENP019944
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 6590 - protein, 5 aa, Artificial Sequence
  Description of Artificial Sequence: Synthetic peptide
  XENP019944 vhCDR1
SYTMH

SEQ ID NO: 6591 - protein, 17 aa, Artificial Sequence
  Description of Artificial Sequence: Synthetic peptide
  XENP019944 vhCDR2
FISYDGNNKYYADSVKG

SEQ ID NO: 6592 - protein, 9 aa, Artificial Sequence
  Description of Artificial Sequence: Synthetic peptide
  XENP019944 vhCDR3
TGWLGPFDY

SEQ ID NO: 6593 - protein, 12 aa, Artificial Sequence
  Description of Artificial Sequence: Synthetic peptide
  XENP019944 vlCDR1
RASQSVGSSYLA

SEQ ID NO: 6594 - protein, 7 aa, Artificial Sequence
  Description of Artificial Sequence: Synthetic peptide
  XENP019944 vlCDR2
GAFSRAT

SEQ ID NO: 6595 - protein, 9 aa, Artificial Sequence
  Description of Artificial Sequence: Synthetic peptide
  XENP019944 vlCDR3
QQYGSSPWT

SEQ ID NO: 6596 - protein, 246 aa, Artificial Sequence
  Description of Artificial Sequence: Synthetic polypeptide
  XENP019945 [CTLA-4]_H0_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 6597 - protein, 118 aa, Artificial Sequence; identical to SEQ ID NO: 3737
  Description of Artificial Sequence: Synthetic polypeptide
  VH of XENP019945

SEQ ID NO: 6598 - protein, 108 aa, Artificial Sequence; identical to SEQ ID NO: 4762
  Description of Artificial Sequence: Synthetic polypeptide
  VL of XENP019945

SEQ ID NO: 6599 - protein, 5 aa, Artificial Sequence
  Description of Artificial Sequence: Synthetic peptide
  XENP019945 vhCDR1
SYTMH

SEQ ID NO: 6600 - protein, 17 aa, Artificial Sequence
  Description of Artificial Sequence: Synthetic peptide
  XENP019945 vhCDR2
FISYDGNNKYYADSVKG

SEQ ID NO: 6601 - protein, 9 aa, Artificial Sequence
  Description of Artificial Sequence: Synthetic peptide
  XENP019945 vhCDR3
TGWLGPFDY

SEQ ID NO: 6602 - protein, 12 aa, Artificial Sequence
  Description of Artificial Sequence: Synthetic peptide
  XENP019945 vlCDR1
RASQSVGSSYLA

SEQ ID NO: 6603 - protein, 7 aa, Artificial Sequence
  Description of Artificial Sequence: Synthetic peptide
  XENP019945 vlCDR2
GAFSRAT

SEQ ID NO: 6604 - protein, 9 aa, Artificial Sequence
  Description of Artificial Sequence: Synthetic peptide
  XENP019945 vlCDR3
QQYGSSPWT

SEQ ID NO: 6605 - protein, 246 aa, Artificial Sequence
  Description of Artificial Sequence: Synthetic polypeptide
  XENP019946 [CTLA-4]_H0_L0.58_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 6606 - protein, 118 aa, Artificial Sequence; identical to SEQ ID NO: 3737
  Description of Artificial Sequence: Synthetic polypeptide
  VH of XENP019946

SEQ ID NO: 6607 - protein, 108 aa, Artificial Sequence
  Description of Artificial Sequence: Synthetic polypeptide
  VL of XENP019946
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 6608 - protein, 5 aa, Artificial Sequence
  Description of Artificial Sequence: Synthetic peptide
  XENP019946 vhCDR1
SYTMH

SEQ ID NO: 6609 - protein, 17 aa, Artificial Sequence
  Description of Artificial Sequence: Synthetic peptide
  XENP019946 vhCDR2
FISYDGNNKYYADSVKG

SEQ ID NO: 6610 - protein, 9 aa, Artificial Sequence
  Description of Artificial Sequence: Synthetic peptide
  XENP019946 vhCDR3
TGWLGPFDY

SEQ ID NO: 6611 - protein, 12 aa, Artificial Sequence
  Description of Artificial Sequence: Synthetic peptide
  XENP019946 vlCDR1
RASQSVGSSYLA

SEQ ID NO: 6612 - protein, 7 aa, Artificial Sequence
  Description of Artificial Sequence: Synthetic peptide
  XENP019946 vlCDR2
GAFSRAT

SEQ ID NO: 6613 - protein, 9 aa, Artificial Sequence
  Description of Artificial Sequence: Synthetic peptide
  XENP019946 vlCDR3
QQYGSSPWT

SEQ ID NO: 6614 - protein, 246 aa, Artificial Sequence
  Description of Artificial Sequence: Synthetic polypeptide
  XENP019947 [CTLA-4]_H0_L0.59_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 6615 - protein, 118 aa, Artificial Sequence; identical to SEQ ID NO: 3737
  Description of Artificial Sequence: Synthetic polypeptide
  VH of XENP019947

SEQ ID NO: 6616 - protein, 108 aa, Artificial Sequence
  Description of Artificial Sequence: Synthetic polypeptide
  VL of XENP019947
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 6617 - protein, 5 aa, Artificial Sequence
  Description of Artificial Sequence: Synthetic peptide
  XENP019947 vhCDR1
SYTMH

SEQ ID NO: 6618 - protein, 17 aa, Artificial Sequence
  Description of Artificial Sequence: Synthetic peptide
  XENP019947 vhCDR2
FISYDGNNKYYADSVKG

SEQ ID NO: 6619 - protein, 9 aa, Artificial Sequence
  Description of Artificial Sequence: Synthetic peptide
  XENP019947 vhCDR3
TGWLGPFDY

SEQ ID NO: 6620 - protein, 12 aa, Artificial Sequence
  Description of Artificial Sequence: Synthetic peptide
  XENP019947 vlCDR1
RASQSVGSSYLA

SEQ ID NO: 6621 - protein, 7 aa, Artificial Sequence
  Description of Artificial Sequence: Synthetic peptide
  XENP019947 vlCDR2
GAFSRAT

SEQ ID NO: 6622 - protein, 9 aa, Artificial Sequence
  Description of Artificial Sequence: Synthetic peptide
  XENP019947 vlCDR3
QQYGSSPWT

SEQ ID NO: 6623 - protein, 246 aa, Artificial Sequence
  Description of Artificial Sequence: Synthetic polypeptide
  XENP019948 [CTLA-4]_H0_L0.60_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 6624 - protein, 118 aa, Artificial Sequence; identical to SEQ ID NO: 3737
  Description of Artificial Sequence: Synthetic polypeptide
  VH of XENP019948

SEQ ID NO: 6625 - protein, 108 aa, Artificial Sequence
  Description of Artificial Sequence: Synthetic polypeptide
  VL of XENP019948
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 6626 - protein, 5 aa, Artificial Sequence
  Description of Artificial Sequence: Synthetic peptide
  XENP019948 vhCDR1
SYTMH

SEQ ID NO: 6627 - protein, 17 aa, Artificial Sequence
  Description of Artificial Sequence: Synthetic peptide
  XENP019948 vhCDR2
FISYDGNNKYYADSVKG

SEQ ID NO: 6628 - protein, 9 aa, Artificial Sequence
  Description of Artificial Sequence: Synthetic peptide
  XENP019948 vhCDR3
TGWLGPFDY

SEQ ID NO: 6629 - protein, 12 aa, Artificial Sequence
  Description of Artificial Sequence: Synthetic peptide
  XENP019948 vlCDR1
RASQSVGSSYLA

SEQ ID NO: 6630 - protein, 7 aa, Artificial Sequence
  Description of Artificial Sequence: Synthetic peptide
  XENP019948 vlCDR2
GAFSRAT

SEQ ID NO: 6631 - protein, 9 aa, Artificial Sequence
  Description of Artificial Sequence: Synthetic peptide
  XENP019948 vlCDR3
QQYGSSPWT

SEQ ID NO: 6632 - protein, 246 aa, Artificial Sequence
  Description of Artificial Sequence: Synthetic polypeptide
  XENP019949 [CTLA-4]_H0_L0.61_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 6633 - protein, 118 aa, Artificial Sequence; identical to SEQ ID NO: 3737
  Description of Artificial Sequence: Synthetic polypeptide
  VH of XENP019949

SEQ ID NO: 6634 - protein, 108 aa, Artificial Sequence
  Description of Artificial Sequence: Synthetic polypeptide
  VL of XENP019949
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 6635 - protein, 5 aa, Artificial Sequence
  Description of Artificial Sequence: Synthetic peptide
  XENP019949 vhCDR1
SYTMH

SEQ ID NO: 6636 - protein, 17 aa, Artificial Sequence
  Description of Artificial Sequence: Synthetic peptide
  XENP019949 vhCDR2
FISYDGNNKYYADSVKG

SEQ ID NO: 6637 - protein, 9 aa, Artificial Sequence
  Description of Artificial Sequence: Synthetic peptide
  XENP019949 vhCDR3
TGWLGPFDY

SEQ ID NO: 6638 - protein, 12 aa, Artificial Sequence
  Description of Artificial Sequence: Synthetic peptide
  XENP019949 vlCDR1
RASQSVGSSYLA

SEQ ID NO: 6639 - protein, 7 aa, Artificial Sequence
  Description of Artificial Sequence: Synthetic peptide
  XENP019949 vlCDR2
GAFSRDT

SEQ ID NO: 6640 - protein, 9 aa, Artificial Sequence
  Description of Artificial Sequence: Synthetic peptide
  XENP019949 vlCDR3
QQYGSSPWT

SEQ ID NO: 6641 - protein, 246 aa, Artificial Sequence
  Description of Artificial Sequence: Synthetic polypeptide
  XENP019950 [CTLA-4]_H0_L0.62_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 6642 - protein, 118 aa, Artificial Sequence; identical to SEQ ID NO: 3737
  Description of Artificial Sequence: Synthetic polypeptide
  VH of XENP019950

SEQ ID NO: 6643 - protein, 108 aa, Artificial Sequence
  Description of Artificial Sequence: Synthetic polypeptide
  VL of XENP019950
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 6644 - protein, 5 aa, Artificial Sequence
  Description of Artificial Sequence: Synthetic peptide
  XENP019950 vhCDR1
SYTMH

SEQ ID NO: 6645 - protein, 17 aa, Artificial Sequence
  Description of Artificial Sequence: Synthetic peptide
  XENP019950 vhCDR2
FISYDGNNKYYADSVKG

SEQ ID NO: 6646 - protein, 9 aa, Artificial Sequence
  Description of Artificial Sequence: Synthetic peptide
  XENP019950 vhCDR3
TGWLGPFDY

SEQ ID NO: 6647 - protein, 12 aa, Artificial Sequence
  Description of Artificial Sequence: Synthetic peptide
  XENP019950 vlCDR1
RASQSVGSSYLA

SEQ ID NO: 6648 - protein, 7 aa, Artificial Sequence
  Description of Artificial Sequence: Synthetic peptide
  XENP019950 vlCDR2
GAFSRAT

SEQ ID NO: 6649 - protein, 9 aa, Artificial Sequence
  Description of Artificial Sequence: Synthetic peptide
  XENP019950 vlCDR3
QQYGSSPWT

SEQ ID NO: 6650 - protein, 246 aa, Artificial Sequence
  Description of Artificial Sequence: Synthetic polypeptide
  XENP019951 [CTLA-4]_H0_L0.63_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 6651 - protein, 118 aa, Artificial Sequence; identical to SEQ ID NO: 3737
  Description of Artificial Sequence: Synthetic polypeptide
  VH of XENP019951

SEQ ID NO: 6652 - protein, 108 aa, Artificial Sequence
  Description of Artificial Sequence: Synthetic polypeptide
  VL of XENP019951
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 6653 - protein, 5 aa, Artificial Sequence
  Description of Artificial Sequence: Synthetic peptide
  XENP019951 vhCDR1
SYTMH

SEQ ID NO: 6654 - protein, 17 aa, Artificial Sequence
  Description of Artificial Sequence: Synthetic peptide
  XENP019951 vhCDR2
FISYDGNNKYYADSVKG

SEQ ID NO: 6655 - protein, 9 aa, Artificial Sequence
  Description of Artificial Sequence: Synthetic peptide
  XENP019951 vhCDR3
TGWLGPFDY

SEQ ID NO: 6656 - protein, 12 aa, Artificial Sequence
  Description of Artificial Sequence: Synthetic peptide
  XENP019951 vlCDR1
RASQSVGSSYLA

SEQ ID NO: 6657 - protein, 7 aa, Artificial Sequence
  Description of Artificial Sequence: Synthetic peptide
  XENP019951 vlCDR2
GAFSRAT

SEQ ID NO: 6658 - protein, 9 aa, Artificial Sequence
  Description of Artificial Sequence: Synthetic peptide
  XENP019951 vlCDR3
QQYGSSPWT

SEQ ID NO: 6659 - protein, 246 aa, Artificial Sequence
  Description of Artificial Sequence: Synthetic polypeptide
  XENP019952 [CTLA-4]_H0_L0.64_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 6660 - protein, 118 aa, Artificial Sequence; identical to SEQ ID NO: 3737
  Description of Artificial Sequence: Synthetic polypeptide
  VH of XENP019952

SEQ ID NO: 6661 - protein, 108 aa, Artificial Sequence
  Description of Artificial Sequence: Synthetic polypeptide
  VL of XENP019952
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 6662 - protein, 5 aa, Artificial Sequence
  Description of Artificial Sequence: Synthetic peptide
  XENP019952 vhCDR1
SYTMH

SEQ ID NO: 6663 - protein, 17 aa, Artificial Sequence
  Description of Artificial Sequence: Synthetic peptide
  XENP019952 vhCDR2
FISYDGNNKYYADSVKG

SEQ ID NO: 6664 - protein, 9 aa, Artificial Sequence
  Description of Artificial Sequence: Synthetic peptide
  XENP019952 vhCDR3
TGWLGPFDY

SEQ ID NO: 6665 - protein, 12 aa, Artificial Sequence
  Description of Artificial Sequence: Synthetic peptide
  XENP019952 vlCDR1
RASQSVGSSYLA

SEQ ID NO: 6666 - protein, 7 aa, Artificial Sequence
  Description of Artificial Sequence: Synthetic peptide
  XENP019952 vlCDR2
GAFSRAT

SEQ ID NO: 6667 - protein, 9 aa, Artificial Sequence
  Description of Artificial Sequence: Synthetic peptide
  XENP019952 vlCDR3
QQYGSSPWT

SEQ ID NO: 6668 - protein, 246 aa, Artificial Sequence
  Description of Artificial Sequence: Synthetic polypeptide
  XENP019953 [CTLA-4]_H0_L0.65_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 6669 - protein, 118 aa, Artificial Sequence; identical to SEQ ID NO: 3737
  Description of Artificial Sequence: Synthetic polypeptide
  VH of XENP019953

SEQ ID NO: 6670 - protein, 108 aa, Artificial Sequence
  Description of Artificial Sequence: Synthetic polypeptide
  VL of XENP019953
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 6671 - protein, 5 aa, Artificial Sequence
  Description of Artificial Sequence: Synthetic peptide
  XENP019953 vhCDR1
SYTMH

SEQ ID NO: 6672 - protein, 17 aa, Artificial Sequence
  Description of Artificial Sequence: Synthetic peptide
  XENP019953 vhCDR2
FISYDGNNKYYADSVKG

SEQ ID NO: 6673 - protein, 9 aa, Artificial Sequence
  Description of Artificial Sequence: Synthetic peptide
  XENP019953 vhCDR3
TGWLGPFDY

SEQ ID NO: 6674 - protein, 12 aa, Artificial Sequence
  Description of Artificial Sequence: Synthetic peptide
  XENP019953 vlCDR1
RASQSVGSSYLA

SEQ ID NO: 6675 - protein, 7 aa, Artificial Sequence
  Description of Artificial Sequence: Synthetic peptide
  XENP019953 vlCDR2
GAFSRAT

SEQ ID NO: 6676 - protein, 9 aa, Artificial Sequence
  Description of Artificial Sequence: Synthetic peptide
  XENP019953 vlCDR3
QQYGSSPWT

SEQ ID NO: 6677 - protein, 246 aa, Artificial Sequence
  Description of Artificial Sequence: Synthetic polypeptide
  XENP019954 [CTLA-4]_H0_L0.66_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 6678 - protein, 118 aa, Artificial Sequence; identical to SEQ ID NO: 3737
  Description of Artificial Sequence: Synthetic polypeptide
  VH of XENP019954

SEQ ID NO: 6679 - protein, 108 aa, Artificial Sequence
  Description of Artificial Sequence: Synthetic polypeptide
  VL of XENP019954
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 6680 - protein, 5 aa, Artificial Sequence
  Description of Artificial Sequence: Synthetic peptide
  XENP019954 vhCDR1
SYTMH

SEQ ID NO: 6681 - protein, 17 aa, Artificial Sequence
  Description of Artificial Sequence: Synthetic peptide
  XENP019954 vhCDR2
FISYDGNNKYYADSVKG

SEQ ID NO: 6682 - protein, 9 aa, Artificial Sequence
  Description of Artificial Sequence: Synthetic peptide
  XENP019954 vhCDR3
TGWLGPFDY

SEQ ID NO: 6683 - protein, 12 aa, Artificial Sequence
  Description of Artificial Sequence: Synthetic peptide
  XENP019954 vlCDR1
RASQSVGSSYLA

SEQ ID NO: 6684 - protein, 7 aa, Artificial Sequence
  Description of Artificial Sequence: Synthetic peptide
  XENP019954 vlCDR2
GAFSRAT

SEQ ID NO: 6685 - protein, 9 aa, Artificial Sequence
  Description of Artificial Sequence: Synthetic peptide
  XENP019954 vlCDR3
QQYGSSPWT

SEQ ID NO: 6686 - protein, 246 aa, Artificial Sequence
  Description of Artificial Sequence: Synthetic polypeptide
  XENP019955 [CTLA-4]_H0_L0.67_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 6687 - protein, 118 aa, Artificial Sequence; identical to SEQ ID NO: 3737
  Description of Artificial Sequence: Synthetic polypeptide
  VH of XENP019955

SEQ ID NO: 6688 - protein, 108 aa, Artificial Sequence
  Description of Artificial Sequence: Synthetic polypeptide
  VL of XENP019955
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 6689 - protein, 5 aa, Artificial Sequence
  Description of Artificial Sequence: Synthetic peptide
  XENP019955 vhCDR1
SYTMH

SEQ ID NO: 6690 - protein, 17 aa, Artificial Sequence
  Description of Artificial Sequence: Synthetic peptide
  XENP019955 vhCDR2
FISYDGNNKYYADSVKG

SEQ ID NO: 6691 - protein, 9 aa, Artificial Sequence
  Description of Artificial Sequence: Synthetic peptide
  XENP019955 vhCDR3
TGWLGPFDY

SEQ ID NO: 6692 - protein, 12 aa, Artificial Sequence
  Description of Artificial Sequence: Synthetic peptide
  XENP019955 vlCDR1
RASQSVGSSYLA

SEQ ID NO: 6693 - protein, 7 aa, Artificial Sequence
  Description of Artificial Sequence: Synthetic peptide
  XENP019955 vlCDR2
DAFSRAT

SEQ ID NO: 6694 - protein, 9 aa, Artificial Sequence
  Description of Artificial Sequence: Synthetic peptide
  XENP019955 vlCDR3
QQYGSSPWT

SEQ ID NO: 6695 - protein, 246 aa, Artificial Sequence
  Description of Artificial Sequence: Synthetic polypeptide
  XENP019956 [CTLA-4]_H0_L0.68_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 6696 - protein, 118 aa, Artificial Sequence; identical to SEQ ID NO: 3737
  Description of Artificial Sequence: Synthetic polypeptide
  VH of XENP019956

SEQ ID NO: 6697 - protein, 108 aa, Artificial Sequence
  Description of Artificial Sequence: Synthetic polypeptide
  VL of XENP019956
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 6698 - protein, 5 aa, Artificial Sequence
  Description of Artificial Sequence: Synthetic peptide
  XENP019956 vhCDR1
SYTMH

SEQ ID NO: 6699 - protein, 17 aa, Artificial Sequence
  Description of Artificial Sequence: Synthetic peptide
  XENP019956 vhCDR2
FISYDGNNKYYADSVKG

SEQ ID NO: 6700 - protein, 9 aa, Artificial Sequence
  Description of Artificial Sequence: Synthetic peptide
  XENP019956 vhCDR3
TGWLGPFDY

SEQ ID NO: 6701 - protein, 12 aa, Artificial Sequence
  Description of Artificial Sequence: Synthetic peptide
  XENP019956 vlCDR1
RASQSVGSSYLA

SEQ ID NO: 6702 - protein, 7 aa, Artificial Sequence
  Description of Artificial Sequence: Synthetic peptide
  XENP019956 vlCDR2
SAFSRAT

SEQ ID NO: 6703 - protein, 9 aa, Artificial Sequence
  Description of Artificial Sequence: Synthetic peptide
  XENP019956 vlCDR3
QQYGSSPWT

SEQ ID NO: 6704 - protein, 246 aa, Artificial Sequence
  Description of Artificial Sequence: Synthetic polypeptide
  XENP019957 [CTLA-4]_H0_L0.69_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 6705 - protein, 118 aa, Artificial Sequence; identical to SEQ ID NO: 3737
  Description of Artificial Sequence: Synthetic polypeptide
  VH of XENP019957

SEQ ID NO: 6706 - protein, 108 aa, Artificial Sequence
  Description of Artificial Sequence: Synthetic polypeptide
  VL of XENP019957
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 6707 - protein, 5 aa, Artificial Sequence
  Description of Artificial Sequence: Synthetic peptide
  XENP019957 vhCDR1
SYTMH

SEQ ID NO: 6708 - protein, 17 aa, Artificial Sequence
  Description of Artificial Sequence: Synthetic peptide
  XENP019957 vhCDR2
FISYDGNNKYYADSVKG

SEQ ID NO: 6709 - protein, 9 aa, Artificial Sequence
  Description of Artificial Sequence: Synthetic peptide
  XENP019957 vhCDR3
TGWLGPFDY

SEQ ID NO: 6710 - protein, 12 aa, Artificial Sequence
  Description of Artificial Sequence: Synthetic peptide
  XENP019957 vlCDR1
RASQSVGSSYLA

SEQ ID NO: 6711 - protein, 7 aa, Artificial Sequence
  Description of Artificial Sequence: Synthetic peptide
  XENP019957 vlCDR2
GVFSRAT

SEQ ID NO: 6712 - protein, 9 aa, Artificial Sequence
  Description of Artificial Sequence: Synthetic peptide
  XENP019957 vlCDR3
QQYGSSPWT

SEQ ID NO: 6713 - protein, 246 aa, Artificial Sequence
  Description of Artificial Sequence: Synthetic polypeptide
  XENP019958 [CTLA-4]_H0_L0.70_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 6714 - protein, 118 aa, Artificial Sequence; identical to SEQ ID NO: 3737
  Description of Artificial Sequence: Synthetic polypeptide
  VH of XENP019958

SEQ ID NO: 6715 - protein, 108 aa, Artificial Sequence
  Description of Artificial Sequence: Synthetic polypeptide
  VL of XENP019958
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 6716 - protein, 5 aa, Artificial Sequence
  Description of Artificial Sequence: Synthetic peptide
  XENP019958 vhCDR1
SYTMH

SEQ ID NO: 6717 - protein, 17 aa, Artificial Sequence
  Description of Artificial Sequence: Synthetic peptide
  XENP019958 vhCDR2
FISYDGNNKYYADSVKG

SEQ ID NO: 6718 - protein, 9 aa, Artificial Sequence
  Description of Artificial Sequence: Synthetic peptide
  XENP019958 vhCDR3
TGWLGPFDY

SEQ ID NO: 6719 - protein, 12 aa, Artificial Sequence
  Description of Artificial Sequence: Synthetic peptide
  XENP019958 vlCDR1
RASQSVGSSYLA

SEQ ID NO: 6720 - protein, 7 aa, Artificial Sequence
  Description of Artificial Sequence: Synthetic peptide
  XENP019958 vlCDR2
GAHSRAT

SEQ ID NO: 6721 - protein, 9 aa, Artificial Sequence
  Description of Artificial Sequence: Synthetic peptide
  XENP019958 vlCDR3
QQYGSSPWT

SEQ ID NO: 6722 - protein, 246 aa, Artificial Sequence
  Description of Artificial Sequence: Synthetic polypeptide
  XENP019959 [CTLA-4]_H0_L0.71_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 6723 - protein, 118 aa, Artificial Sequence; identical to SEQ ID NO: 3737
  Description of Artificial Sequence: Synthetic polypeptide
  VH of XENP019959

SEQ ID NO: 6724 - protein, 108 aa, Artificial Sequence
  Description of Artificial Sequence: Synthetic polypeptide
  VL of XENP019959
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 6725 - protein, 5 aa, Artificial Sequence
  Description of Artificial Sequence: Synthetic peptide
  XENP019959 vhCDR1
SYTMH

SEQ ID NO: 6726 - protein, 17 aa, Artificial Sequence
  Description of Artificial Sequence: Synthetic peptide
  XENP019959 vhCDR2
FISYDGNNKYYADSVKG

SEQ ID NO: 6727 - protein, 9 aa, Artificial Sequence
  Description of Artificial Sequence: Synthetic peptide
  XENP019959 vhCDR3
TGWLGPFDY

SEQ ID NO: 6728 - protein, 12 aa, Artificial Sequence
  Description of Artificial Sequence: Synthetic peptide
  XENP019959 vlCDR1
RASQSVGSSYLA

SEQ ID NO: 6729 - protein, 7 aa, Artificial Sequence
  Description of Artificial Sequence: Synthetic peptide
  XENP019959 vlCDR2
GAISRAT

SEQ ID NO: 6730 - protein, 9 aa, Artificial Sequence
  Description of Artificial Sequence: Synthetic peptide
  XENP019959 vlCDR3
QQYGSSPWT

SEQ ID NO: 6731 - protein, 246 aa, Artificial Sequence
  Description of Artificial Sequence: Synthetic polypeptide
  XENP019960 [CTLA-4]_H0_L0.72_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 6732 - protein, 118 aa, Artificial Sequence; identical to SEQ ID NO: 3737
  Description of Artificial Sequence: Synthetic polypeptide
  VH of XENP019960

SEQ ID NO: 6733 - protein, 108 aa, Artificial Sequence
  Description of Artificial Sequence: Synthetic polypeptide
  VL of XENP019960
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 6734 - protein, 5 aa, Artificial Sequence
  Description of Artificial Sequence: Synthetic peptide
  XENP019960 vhCDR1
SYTMH

SEQ ID NO: 6735 - protein, 17 aa, Artificial Sequence
  Description of Artificial Sequence: Synthetic peptide
  XENP019960 vhCDR2
FISYDGNNKYYADSVKG

SEQ ID NO: 6736 - protein, 9 aa, Artificial Sequence
  Description of Artificial Sequence: Synthetic peptide
  XENP019960 vhCDR3
TGWLGPFDY

SEQ ID NO: 6737 - protein, 12 aa, Artificial Sequence
  Description of Artificial Sequence: Synthetic peptide
  XENP019960 vlCDR1
RASQSVGSSYLA

SEQ ID NO: 6738 - protein, 7 aa, Artificial Sequence
  Description of Artificial Sequence: Synthetic peptide
  XENP019960 vlCDR2
GALSRAT

SEQ ID NO: 6739 - protein, 9 aa, Artificial Sequence
  Description of Artificial Sequence: Synthetic peptide
  XENP019960 vlCDR3
QQYGSSPWT

SEQ ID NO: 6740 - protein, 246 aa, Artificial Sequence
  Description of Artificial Sequence: Synthetic polypeptide
  XENP019961 [CTLA-4]_H0_L0.73_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 6741 - protein, 118 aa, Artificial Sequence; identical to SEQ ID NO: 3737
  Description of Artificial Sequence: Synthetic polypeptide
  VH of XENP019961

SEQ ID NO: 6742 - protein, 108 aa, Artificial Sequence
  Description of Artificial Sequence: Synthetic polypeptide
  VL of XENP019961
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 6743 - protein, 5 aa, Artificial Sequence
  Description of Artificial Sequence: Synthetic peptide
  XENP019961 vhCDR1
SYTMH

SEQ ID NO: 6744 - protein, 17 aa, Artificial Sequence
  Description of Artificial Sequence: Synthetic peptide
  XENP019961 vhCDR2
FISYDGNNKYYADSVKG

SEQ ID NO: 6745 - protein, 9 aa, Artificial Sequence
  Description of Artificial Sequence: Synthetic peptide
  XENP019961 vhCDR3
TGWLGPFDY

SEQ ID NO: 6746 - protein, 12 aa, Artificial Sequence
  Description of Artificial Sequence: Synthetic peptide
  XENP019961 vlCDR1
RASQSVGSSYLA

SEQ ID NO: 6747 - protein, 7 aa, Artificial Sequence
  Description of Artificial Sequence: Synthetic peptide
  XENP019961 vlCDR2
GASSRAT

SEQ ID NO: 6748 - protein, 9 aa, Artificial Sequence
  Description of Artificial Sequence: Synthetic peptide
  XENP019961 vlCDR3
QQYGSSPWT

SEQ ID NO: 6749 - protein, 246 aa, Artificial Sequence
  Description of Artificial Sequence: Synthetic polypeptide
  XENP019962 [CTLA-4]_H0_L0.74_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 6750 - protein, 118 aa, Artificial Sequence; identical to SEQ ID NO: 3737
  Description of Artificial Sequence: Synthetic polypeptide
  VH of XENP019962

SEQ ID NO: 6751 - protein, 108 aa, Artificial Sequence
  Description of Artificial Sequence: Synthetic polypeptide
  VL of XENP019962
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 6752 - protein, 5 aa, Artificial Sequence
  Description of Artificial Sequence: Synthetic peptide
  XENP019962 vhCDR1
SYTMH

SEQ ID NO: 6753 - protein, 17 aa, Artificial Sequence
  Description of Artificial Sequence: Synthetic peptide
  XENP019962 vhCDR2
FISYDGNNKYYADSVKG

SEQ ID NO: 6754 - protein, 9 aa, Artificial Sequence
  Description of Artificial Sequence: Synthetic peptide
  XENP019962 vhCDR3
TGWLGPFDY

SEQ ID NO: 6755 - protein, 12 aa, Artificial Sequence
  Description of Artificial Sequence: Synthetic peptide
  XENP019962 vlCDR1
RASQSVGSSYLA

SEQ ID NO: 6756 - protein, 7 aa, Artificial Sequence
  Description of Artificial Sequence: Synthetic peptide
  XENP019962 vlCDR2
GAYSRAT

SEQ ID NO: 6757 - protein, 9 aa, Artificial Sequence
  Description of Artificial Sequence: Synthetic peptide
  XENP019962 vlCDR3
QQYGSSPWT

SEQ ID NO: 6758 - protein, 246 aa, Artificial Sequence
  Description of Artificial Sequence: Synthetic polypeptide
  XENP019963 [CTLA-4]_H0_L0.75_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 6759 - protein, 118 aa, Artificial Sequence; identical to SEQ ID NO: 3737
  Description of Artificial Sequence: Synthetic polypeptide
  VH of XENP019963

SEQ ID NO: 6760 - protein, 108 aa, Artificial Sequence
  Description of Artificial Sequence: Synthetic polypeptide
  VL of XENP019963
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 6761 - protein, 5 aa, Artificial Sequence
  Description of Artificial Sequence: Synthetic peptide
  XENP019963 vhCDR1
SYTMH

SEQ ID NO: 6762 - protein, 17 aa, Artificial Sequence
  Description of Artificial Sequence: Synthetic peptide
  XENP019963 vhCDR2
FISYDGNNKYYADSVKG

SEQ ID NO: 6763 - protein, 9 aa, Artificial Sequence
  Description of Artificial Sequence: Synthetic peptide
  XENP019963 vhCDR3
TGWLGPFDY

SEQ ID NO: 6764 - protein, 12 aa, Artificial Sequence
  Description of Artificial Sequence: Synthetic peptide
  XENP019963 vlCDR1
RASQSVGSSYLA

SEQ ID NO: 6765 - protein, 7 aa, Artificial Sequence
  Description of Artificial Sequence: Synthetic peptide
  XENP019963 vlCDR2
GAFARAT

SEQ ID NO: 6766 - protein, 9 aa, Artificial Sequence
  Description of Artificial Sequence: Synthetic peptide
  XENP019963 vlCDR3
QQYGSSPWT

SEQ ID NO: 6767 - protein, 246 aa, Artificial Sequence
  Description of Artificial Sequence: Synthetic polypeptide
  XENP019964 [CTLA-4]_H0_L0.76_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 6768 - protein, 118 aa, Artificial Sequence; identical to SEQ ID NO: 3737
  Description of Artificial Sequence: Synthetic polypeptide
  VH of XENP019964

SEQ ID NO: 6769 - protein, 108 aa, Artificial Sequence
  Description of Artificial Sequence: Synthetic polypeptide
  VL of XENP019964
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 6770 - protein, 5 aa, Artificial Sequence
  Description of Artificial Sequence: Synthetic peptide
  XENP019964 vhCDR1
SYTMH

SEQ ID NO: 6771 - protein, 17 aa, Artificial Sequence
  Description of Artificial Sequence: Synthetic peptide
  XENP019964 vhCDR2
FISYDGNNKYYADSVKG

SEQ ID NO: 6772 - protein, 9 aa, Artificial Sequence
  Description of Artificial Sequence: Synthetic peptide
  XENP019964 vhCDR3
TGWLGPFDY

SEQ ID NO: 6773 - protein, 12 aa, Artificial Sequence
  Description of Artificial Sequence: Synthetic peptide
  XENP019964 vlCDR1
RASQSVGSSYLA

SEQ ID NO: 6774 - protein, 7 aa, Artificial Sequence
  Description of Artificial Sequence: Synthetic peptide
  XENP019964 vlCDR2
GAFGRAT

SEQ ID NO: 6775 - protein, 9 aa, Artificial Sequence
  Description of Artificial Sequence: Synthetic peptide
  XENP019964 vlCDR3
QQYGSSPWT

SEQ ID NO: 6776 - protein, 246 aa, Artificial Sequence
  Description of Artificial Sequence: Synthetic polypeptide
  XENP019965 [CTLA-4]_H0_L0.77_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 6777 - protein, 118 aa, Artificial Sequence; identical to SEQ ID NO: 3737
  Description of Artificial Sequence: Synthetic polypeptide
  VH of XENP019965

SEQ ID NO: 6778 - protein, 108 aa, Artificial Sequence
  Description of Artificial Sequence: Synthetic polypeptide
  VL of XENP019965
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 6779 - protein, 5 aa, Artificial Sequence
  Description of Artificial Sequence: Synthetic peptide
  XENP019965 vhCDR1
SYTMH

SEQ ID NO: 6780 - protein, 17 aa, Artificial Sequence
  Description of Artificial Sequence: Synthetic peptide
  XENP019965 vhCDR2
FISYDGNNKYYADSVKG

SEQ ID NO: 6781 - protein, 9 aa, Artificial Sequence
  Description of Artificial Sequence: Synthetic peptide
  XENP019965 vhCDR3
TGWLGPFDY

SEQ ID NO: 6782 - protein, 12 aa, Artificial Sequence
  Description of Artificial Sequence: Synthetic peptide
  XENP019965 vlCDR1
RASQSVGSSYLA

SEQ ID NO: 6783 - protein, 7 aa, Artificial Sequence
  Description of Artificial Sequence: Synthetic peptide
  XENP019965 vlCDR2
GAFNRAT

SEQ ID NO: 6784 - protein, 9 aa, Artificial Sequence
  Description of Artificial Sequence: Synthetic peptide
  XENP019965 vlCDR3
QQYGSSPWT

SEQ ID NO: 6785 - protein, 246 aa, Artificial Sequence
  Description of Artificial Sequence: Synthetic polypeptide
  XENP019966 [CTLA-4]_H0_L0.78_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 6786 - protein, 118 aa, Artificial Sequence; identical to SEQ ID NO: 3737
  Description of Artificial Sequence: Synthetic polypeptide
  VH of XENP019966

SEQ ID NO: 6787 - protein, 108 aa, Artificial Sequence
  Description of Artificial Sequence: Synthetic polypeptide
  VL of XENP019966
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 6788 - protein, 5 aa, Artificial Sequence
  Description of Artificial Sequence: Synthetic peptide
  XENP019966 vhCDR1
SYTMH

SEQ ID NO: 6789 - protein, 17 aa, Artificial Sequence
  Description of Artificial Sequence: Synthetic peptide
  XENP019966 vhCDR2
FISYDGNNKYYADSVKG

SEQ ID NO: 6790 - protein, 9 aa, Artificial Sequence
  Description of Artificial Sequence: Synthetic peptide
  XENP019966 vhCDR3
TGWLGPFDY

SEQ ID NO: 6791 - protein, 12 aa, Artificial Sequence
  Description of Artificial Sequence: Synthetic peptide
  XENP019966 vlCDR1
RASQSVGSSYLA

SEQ ID NO: 6792 - protein, 7 aa, Artificial Sequence
  Description of Artificial Sequence: Synthetic peptide
  XENP019966 vlCDR2
GAFQRAT

SEQ ID NO: 6793 - protein, 9 aa, Artificial Sequence
  Description of Artificial Sequence: Synthetic peptide
  XENP019966 vlCDR3
QQYGSSPWT

SEQ ID NO: 6794 - protein, 246 aa, Artificial Sequence
  Description of Artificial Sequence: Synthetic polypeptide
  XENP019967 [CTLA-4]_H0_L0.79_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 6795 - protein, 118 aa, Artificial Sequence; identical to SEQ ID NO: 3737
  Description of Artificial Sequence: Synthetic polypeptide
  VH of XENP019967

SEQ ID NO: 6796 - protein, 108 aa, Artificial Sequence
  Description of Artificial Sequence: Synthetic polypeptide
  VL of XENP019967
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 6797 - protein, 5 aa, Artificial Sequence
  Description of Artificial Sequence: Synthetic peptide
  XENP019967 vhCDR1
SYTMH

SEQ ID NO: 6798 - protein, 17 aa, Artificial Sequence
  Description of Artificial Sequence: Synthetic peptide
  XENP019967 vhCDR2
FISYDGNNKYYADSVKG

SEQ ID NO: 6799 - protein, 9 aa, Artificial Sequence
  Description of Artificial Sequence: Synthetic peptide
  XENP019967 vhCDR3
TGWLGPFDY

SEQ ID NO: 6800 - protein, 12 aa, Artificial Sequence
  Description of Artificial Sequence: Synthetic peptide
  XENP019967 vlCDR1
RASQSVGSSYLA

SEQ ID NO: 6801 - protein, 7 aa, Artificial Sequence
  Description of Artificial Sequence: Synthetic peptide
  XENP019967 vlCDR2
GAFTRAT

SEQ ID NO: 6802 - protein, 9 aa, Artificial Sequence
  Description of Artificial Sequence: Synthetic peptide
  XENP019967 vlCDR3
QQYGSSPWT

SEQ ID NO: 6803 - protein, 246 aa, Artificial Sequence
  Description of Artificial Sequence: Synthetic polypeptide
  XENP019968 [CTLA-4]_H0_L0.80_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 6804 - protein, 118 aa, Artificial Sequence; identical to SEQ ID NO: 3737
  Description of Artificial Sequence: Synthetic polypeptide
  VH of XENP019968

SEQ ID NO: 6805 - protein, 108 aa, Artificial Sequence
  Description of Artificial Sequence: Synthetic polypeptide
  VL of XENP019968
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 6806 - protein, 5 aa, Artificial Sequence
  Description of Artificial Sequence: Synthetic peptide
  XENP019968 vhCDR1
SYTMH

SEQ ID NO: 6807 - protein, 17 aa, Artificial Sequence
  Description of Artificial Sequence: Synthetic peptide
  XENP019968 vhCDR2
FISYDGNNKYYADSVKG

SEQ ID NO: 6808 - protein, 9 aa, Artificial Sequence
  Description of Artificial Sequence: Synthetic peptide
  XENP019968 vhCDR3
TGWLGPFDY

SEQ ID NO: 6809 - protein, 12 aa, Artificial Sequence
  Description of Artificial Sequence: Synthetic peptide
  XENP019968 vlCDR1
RASQSVGSSYLA

SEQ ID NO: 6810 - protein, 7 aa, Artificial Sequence
  Description of Artificial Sequence: Synthetic peptide
  XENP019968 vlCDR2
GAFSRDT

SEQ ID NO: 6811 - protein, 9 aa, Artificial Sequence
  Description of Artificial Sequence: Synthetic peptide
  XENP019968 vlCDR3
QQYGSSPWT

SEQ ID NO: 6812 - protein, 246 aa, Artificial Sequence
  Description of Artificial Sequence: Synthetic polypeptide
  XENP019969 [CTLA-4]_H0_L0.81_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 6813 - protein, 118 aa, Artificial Sequence; identical to SEQ ID NO: 3737
  Description of Artificial Sequence: Synthetic polypeptide
  VH of XENP019969

SEQ ID NO: 6814 - protein, 108 aa, Artificial Sequence
  Description of Artificial Sequence: Synthetic polypeptide
  VL of XENP019969
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 6815 - protein, 5 aa, Artificial Sequence
  Description of Artificial Sequence: Synthetic peptide
  XENP019969 vhCDR1
SYTMH

SEQ ID NO: 6816 - protein, 17 aa, Artificial Sequence
  Description of Artificial Sequence: Synthetic peptide
  XENP019969 vhCDR2
FISYDGNNKYYADSVKG

SEQ ID NO: 6817 - protein, 9 aa, Artificial Sequence
  Description of Artificial Sequence: Synthetic peptide
  XENP019969 vhCDR3
TGWLGPFDY

SEQ ID NO: 6818 - protein, 12 aa, Artificial Sequence
  Description of Artificial Sequence: Synthetic peptide
  XENP019969 vlCDR1
RASQSVGSSYLA

SEQ ID NO: 6819 - protein, 7 aa, Artificial Sequence
  Description of Artificial Sequence: Synthetic peptide
  XENP019969 vlCDR2
GAFSRAS

SEQ ID NO: 6820 - protein, 9 aa, Artificial Sequence
  Description of Artificial Sequence: Synthetic peptide
  XENP019969 vlCDR3
QQYGSSPWT

SEQ ID NO: 6821 - protein, 246 aa, Artificial Sequence
  Description of Artificial Sequence: Synthetic polypeptide
  XENP019970 [CTLA-4]_H0_L0.82_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 6822 - protein, 118 aa, Artificial Sequence; identical to SEQ ID NO: 3737
  Description of Artificial Sequence: Synthetic polypeptide
  VH of XENP019970

SEQ ID NO: 6823 - protein, 108 aa, Artificial Sequence
  Description of Artificial Sequence: Synthetic polypeptide
  VL of XENP019970
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 6824 - protein, 5 aa, Artificial Sequence
  Description of Artificial Sequence: Synthetic peptide
  XENP019970 vhCDR1
SYTMH

SEQ ID NO: 6825 - protein, 17 aa, Artificial Sequence
  Description of Artificial Sequence: Synthetic peptide
  XENP019970 vhCDR2
FISYDGNNKYYADSVKG

SEQ ID NO: 6826 - protein, 9 aa, Artificial Sequence
  Description of Artificial Sequence: Synthetic peptide
  XENP019970 vhCDR3
TGWLGPFDY

SEQ ID NO: 6827 - protein, 12 aa, Artificial Sequence
  Description of Artificial Sequence: Synthetic peptide
  XENP019970 vlCDR1
RASQSVGSSYLA

SEQ ID NO: 6828 - protein, 7 aa, Artificial Sequence
  Description of Artificial Sequence: Synthetic peptide
  XENP019970 vlCDR2
GAFSRAT

SEQ ID NO: 6829 - protein, 9 aa, Artificial Sequence
  Description of Artificial Sequence: Synthetic peptide
  XENP019970 vlCDR3
QQYGSSPWT

SEQ ID NO: 6830 - protein, 246 aa, Artificial Sequence
  Description of Artificial Sequence: Synthetic polypeptide
  XENP019971 [CTLA-4]_H0_L0.83_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 6831 - protein, 118 aa, Artificial Sequence; identical to SEQ ID NO: 3737
  Description of Artificial Sequence: Synthetic polypeptide
  VH of XENP019971

SEQ ID NO: 6832 - protein, 108 aa, Artificial Sequence
  Description of Artificial Sequence: Synthetic polypeptide
  VL of XENP019971
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 6833 - protein, 5 aa, Artificial Sequence
  Description of Artificial Sequence: Synthetic peptide
  XENP019971 vhCDR1
SYTMH

SEQ ID NO: 6834 - protein, 17 aa, Artificial Sequence
  Description of Artificial Sequence: Synthetic peptide
  XENP019971 vhCDR2
FISYDGNNKYYADSVKG

SEQ ID NO: 6835 - protein, 9 aa, Artificial Sequence
  Description of Artificial Sequence: Synthetic peptide
  XENP019971 vhCDR3
TGWLGPFDY

SEQ ID NO: 6836 - protein, 12 aa, Artificial Sequence
  Description of Artificial Sequence: Synthetic peptide
  XENP019971 vlCDR1
RASQSVGSSYLA

SEQ ID NO: 6837 - protein, 7 aa, Artificial Sequence
  Description of Artificial Sequence: Synthetic peptide
  XENP019971 vlCDR2
GAFSRAT

SEQ ID NO: 6838 - protein, 9 aa, Artificial Sequence
  Description of Artificial Sequence: Synthetic peptide
  XENP019971 vlCDR3
QQYGSSPWT

SEQ ID NO: 6839 - protein, 246 aa, Artificial Sequence
  Description of Artificial Sequence: Synthetic polypeptide
  XENP019972 [CTLA-4]_H0_L0.84_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 6840 - protein, 118 aa, Artificial Sequence; identical to SEQ ID NO: 3737
  Description of Artificial Sequence: Synthetic polypeptide
  VH of XENP019972

SEQ ID NO: 6841 - protein, 108 aa, Artificial Sequence
  Description of Artificial Sequence: Synthetic polypeptide
  VL of XENP019972
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 6842 - protein, 5 aa, Artificial Sequence
  Description of Artificial Sequence: Synthetic peptide
  XENP019972 vhCDR1
SYTMH

SEQ ID NO: 6843 - protein, 17 aa, Artificial Sequence
  Description of Artificial Sequence: Synthetic peptide
  XENP019972 vhCDR2
FISYDGNNKYYADSVKG

SEQ ID NO: 6844 - protein, 9 aa, Artificial Sequence
  Description of Artificial Sequence: Synthetic peptide
  XENP019972 vhCDR3
TGWLGPFDY

SEQ ID NO: 6845 - protein, 12 aa, Artificial Sequence
  Description of Artificial Sequence: Synthetic peptide
  XENP019972 vlCDR1
RASQSVGSSYLA

SEQ ID NO: 6846 - protein, 7 aa, Artificial Sequence
  Description of Artificial Sequence: Synthetic peptide
  XENP019972 vlCDR2
GAFSRAT

SEQ ID NO: 6847 - protein, 9 aa, Artificial Sequence
  Description of Artificial Sequence: Synthetic peptide
  XENP019972 vlCDR3
QQYGSSPWT

SEQ ID NO: 6848 - protein, 246 aa, Artificial Sequence
  Description of Artificial Sequence: Synthetic polypeptide
  XENP019973 [CTLA-4]_H0_L0.85_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 6849 - protein, 118 aa, Artificial Sequence; identical to SEQ ID NO: 3737
  Description of Artificial Sequence: Synthetic polypeptide
  VH of XENP019973

SEQ ID NO: 6850 - protein, 108 aa, Artificial Sequence
  Description of Artificial Sequence: Synthetic polypeptide
  VL of XENP019973
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 6851 - protein, 5 aa, Artificial Sequence
  Description of Artificial Sequence: Synthetic peptide
  XENP019973 vhCDR1
SYTMH

SEQ ID NO: 6852 - protein, 17 aa, Artificial Sequence
  Description of Artificial Sequence: Synthetic peptide
  XENP019973 vhCDR2
FISYDGNNKYYADSVKG

SEQ ID NO: 6853 - protein, 9 aa, Artificial Sequence
  Description of Artificial Sequence: Synthetic peptide
  XENP019973 vhCDR3
TGWLGPFDY

SEQ ID NO: 6854 - protein, 12 aa, Artificial Sequence
  Description of Artificial Sequence: Synthetic peptide
  XENP019973 vlCDR1
RASQSVGSSYLA

SEQ ID NO: 6855 - protein, 7 aa, Artificial Sequence
  Description of Artificial Sequence: Synthetic peptide
  XENP019973 vlCDR2
GAFSRAT

SEQ ID NO: 6856 - protein, 9 aa, Artificial Sequence
  Description of Artificial Sequence: Synthetic peptide
  XENP019973 vlCDR3
QQYGSSPWT

SEQ ID NO: 6857 - protein, 246 aa, Artificial Sequence
  Description of Artificial Sequence: Synthetic polypeptide
  XENP019974 [CTLA-4]_H0_L0.86_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 6858 - protein, 118 aa, Artificial Sequence; identical to SEQ ID NO: 3737
  Description of Artificial Sequence: Synthetic polypeptide
  VH of XENP019974

SEQ ID NO: 6859 - protein, 108 aa, Artificial Sequence
  Description of Artificial Sequence: Synthetic polypeptide
  VL of XENP019974
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 6860 - protein, 5 aa, Artificial Sequence
  Description of Artificial Sequence: Synthetic peptide
  XENP019974 vhCDR1
SYTMH

SEQ ID NO: 6861 - protein, 17 aa, Artificial Sequence
  Description of Artificial Sequence: Synthetic peptide
  XENP019974 vhCDR2
FISYDGNNKYYADSVKG

SEQ ID NO: 6862 - protein, 9 aa, Artificial Sequence
  Description of Artificial Sequence: Synthetic peptide
  XENP019974 vhCDR3
TGWLGPFDY

SEQ ID NO: 6863 - protein, 12 aa, Artificial Sequence
  Description of Artificial Sequence: Synthetic peptide
  XENP019974 vlCDR1
RASQSVGSSYLA

SEQ ID NO: 6864 - protein, 7 aa, Artificial Sequence
  Description of Artificial Sequence: Synthetic peptide
  XENP019974 vlCDR2
GAFSRAT

SEQ ID NO: 6865 - protein, 9 aa, Artificial Sequence
  Description of Artificial Sequence: Synthetic peptide
  XENP019974 vlCDR3
QQYGSSPWT

SEQ ID NO: 6866 - protein, 246 aa, Artificial Sequence
  Description of Artificial Sequence: Synthetic polypeptide
  XENP019975 [CTLA-4]_H0_L0.87_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 6867 - protein, 118 aa, Artificial Sequence; identical to SEQ ID NO: 3737
  Description of Artificial Sequence: Synthetic polypeptide
  VH of XENP019975

SEQ ID NO: 6868 - protein, 108 aa, Artificial Sequence
  Description of Artificial Sequence: Synthetic polypeptide
  VL of XENP019975
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 6869 - protein, 5 aa, Artificial Sequence
  Description of Artificial Sequence: Synthetic peptide
  XENP019975 vhCDR1
SYTMH

SEQ ID NO: 6870 - protein, 17 aa, Artificial Sequence
  Description of Artificial Sequence: Synthetic peptide
  XENP019975 vhCDR2
FISYDGNNKYYADSVKG

SEQ ID NO: 6871 - protein, 9 aa, Artificial Sequence
  Description of Artificial Sequence: Synthetic peptide
  XENP019975 vhCDR3
TGWLGPFDY

SEQ ID NO: 6872 - protein, 12 aa, Artificial Sequence
  Description of Artificial Sequence: Synthetic peptide
  XENP019975 vlCDR1
RASQSVGSSYLA

SEQ ID NO: 6873 - protein, 7 aa, Artificial Sequence
  Description of Artificial Sequence: Synthetic peptide
  XENP019975 vlCDR2
GAFSRAT

SEQ ID NO: 6874 - protein, 9 aa, Artificial Sequence
  Description of Artificial Sequence: Synthetic peptide
  XENP019975 vlCDR3
QQYGSSPWT

SEQ ID NO: 6875 - protein, 246 aa, Artificial Sequence
  Description of Artificial Sequence: Synthetic polypeptide
  XENP019976 [CTLA-4]_H0_L0.88_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 6876 - protein, 118 aa, Artificial Sequence; identical to SEQ ID NO: 3737
  Description of Artificial Sequence: Synthetic polypeptide
  VH of XENP019976

SEQ ID NO: 6877 - protein, 108 aa, Artificial Sequence
  Description of Artificial Sequence: Synthetic polypeptide
  VL of XENP019976
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 6878 - protein, 5 aa, Artificial Sequence
  Description of Artificial Sequence: Synthetic peptide
  XENP019976 vhCDR1
SYTMH

SEQ ID NO: 6879 - protein, 17 aa, Artificial Sequence
  Description of Artificial Sequence: Synthetic peptide
  XENP019976 vhCDR2
FISYDGNNKYYADSVKG

SEQ ID NO: 6880 - protein, 9 aa, Artificial Sequence
  Description of Artificial Sequence: Synthetic peptide
  XENP019976 vhCDR3
TGWLGPFDY

SEQ ID NO: 6881 - protein, 12 aa, Artificial Sequence
  Description of Artificial Sequence: Synthetic peptide
  XENP019976 vlCDR1
RASQSVGSSYLA

SEQ ID NO: 6882 - protein, 7 aa, Artificial Sequence
  Description of Artificial Sequence: Synthetic peptide
  XENP019976 vlCDR2
GAFSRAT

SEQ ID NO: 6883 - protein, 9 aa, Artificial Sequence
  Description of Artificial Sequence: Synthetic peptide
  XENP019976 vlCDR3
QQYGSSPWT

SEQ ID NO: 6884 - protein, 246 aa, Artificial Sequence
  Description of Artificial Sequence: Synthetic polypeptide
  XENP019977 [CTLA-4]_H0_L0.89_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 6885 - protein, 118 aa, Artificial Sequence; identical to SEQ ID NO: 3737
  Description of Artificial Sequence: Synthetic polypeptide
  VH of XENP019977

SEQ ID NO: 6886 - protein, 108 aa, Artificial Sequence
  Description of Artificial Sequence: Synthetic polypeptide
  VL of XENP019977
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 6887 - protein, 5 aa, Artificial Sequence
  Description of Artificial Sequence: Synthetic peptide
  XENP019977 vhCDR1
SYTMH

SEQ ID NO: 6888 - protein, 17 aa, Artificial Sequence
  Description of Artificial Sequence: Synthetic peptide
  XENP019977 vhCDR2
FISYDGNNKYYADSVKG

SEQ ID NO: 6889 - protein, 9 aa, Artificial Sequence
  Description of Artificial Sequence: Synthetic peptide
  XENP019977 vhCDR3
TGWLGPFDY

SEQ ID NO: 6890 - protein, 12 aa, Artificial Sequence
  Description of Artificial Sequence: Synthetic peptide
  XENP019977 vlCDR1
RASQSVGSSYLA

SEQ ID NO: 6891 - protein, 7 aa, Artificial Sequence
  Description of Artificial Sequence: Synthetic peptide
  XENP019977 vlCDR2
GAFSRAT

SEQ ID NO: 6892 - protein, 9 aa, Artificial Sequence
  Description of Artificial Sequence: Synthetic peptide
  XENP019977 vlCDR3
QQYGSSPWT

SEQ ID NO: 6893 - protein, 246 aa, Artificial Sequence
  Description of Artificial Sequence: Synthetic polypeptide
  XENP019978 [CTLA-4]_H0_L0.90_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 6894 - protein, 118 aa, Artificial Sequence; identical to SEQ ID NO: 3737
  Description of Artificial Sequence: Synthetic polypeptide
  VH of XENP019978

SEQ ID NO: 6895 - protein, 108 aa, Artificial Sequence
  Description of Artificial Sequence: Synthetic polypeptide
  VL of XENP019978
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 6896 - protein, 5 aa, Artificial Sequence
  Description of Artificial Sequence: Synthetic peptide
  XENP019978 vhCDR1
SYTMH

SEQ ID NO: 6897 - protein, 17 aa, Artificial Sequence
  Description of Artificial Sequence: Synthetic peptide
  XENP019978 vhCDR2
FISYDGNNKYYADSVKG

SEQ ID NO: 6898 - protein, 9 aa, Artificial Sequence
  Description of Artificial Sequence: Synthetic peptide
  XENP019978 vhCDR3
TGWLGPFDY

SEQ ID NO: 6899 - protein, 12 aa, Artificial Sequence
  Description of Artificial Sequence: Synthetic peptide
  XENP019978 vlCDR1
RASQSVGSSYLA

SEQ ID NO: 6900 - protein, 7 aa, Artificial Sequence
  Description of Artificial Sequence: Synthetic peptide
  XENP019978 vlCDR2
GAFSRAT

SEQ ID NO: 6901 - protein, 9 aa, Artificial Sequence
  Description of Artificial Sequence: Synthetic peptide
  XENP019978 vlCDR3
QQYGSSPWT

SEQ ID NO: 6902 - protein, 246 aa, Artificial Sequence
  Description of Artificial Sequence: Synthetic polypeptide
  XENP019979 [CTLA-4]_H0_L0.91_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 6903 - protein, 118 aa, Artificial Sequence; identical to SEQ ID NO: 3737
  Description of Artificial Sequence: Synthetic polypeptide
  VH of XENP019979

SEQ ID NO: 6904 - protein, 108 aa, Artificial Sequence
  Description of Artificial Sequence: Synthetic polypeptide
  VL of XENP019979
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 6905 - protein, 5 aa, Artificial Sequence
  Description of Artificial Sequence: Synthetic peptide
  XENP019979 vhCDR1
SYTMH

SEQ ID NO: 6906 - protein, 17 aa, Artificial Sequence
  Description of Artificial Sequence: Synthetic peptide
  XENP019979 vhCDR2
FISYDGNNKYYADSVKG

SEQ ID NO: 6907 - protein, 9 aa, Artificial Sequence
  Description of Artificial Sequence: Synthetic peptide
  XENP019979 vhCDR3
TGWLGPFDY

SEQ ID NO: 6908 - protein, 12 aa, Artificial Sequence
  Description of Artificial Sequence: Synthetic peptide
  XENP019979 vlCDR1
RASQSVGSSYLA

SEQ ID NO: 6909 - protein, 7 aa, Artificial Sequence
  Description of Artificial Sequence: Synthetic peptide
  XENP019979 vlCDR2
GAFSRAT

SEQ ID NO: 6910 - protein, 9 aa, Artificial Sequence
  Description of Artificial Sequence: Synthetic peptide
  XENP019979 vlCDR3
QQYGSSPWT

SEQ ID NO: 6911 - protein, 246 aa, Artificial Sequence
  Description of Artificial Sequence: Synthetic polypeptide
  XENP019980 [CTLA-4]_H0_L0.92_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 6912 - protein, 118 aa, Artificial Sequence; identical to SEQ ID NO: 3737
  Description of Artificial Sequence: Synthetic polypeptide
  VH of XENP019980

SEQ ID NO: 6913 - protein, 108 aa, Artificial Sequence
  Description of Artificial Sequence: Synthetic polypeptide
  VL of XENP019980
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 6914 - protein, 5 aa, Artificial Sequence
  Description of Artificial Sequence: Synthetic peptide
  XENP019980 vhCDR1
SYTMH

SEQ ID NO: 6915 - protein, 17 aa, Artificial Sequence
  Description of Artificial Sequence: Synthetic peptide
  XENP019980 vhCDR2
FISYDGNNKYYADSVKG

SEQ ID NO: 6916 - protein, 9 aa, Artificial Sequence
  Description of Artificial Sequence: Synthetic peptide
  XENP019980 vhCDR3
TGWLGPFDY

SEQ ID NO: 6917 - protein, 12 aa, Artificial Sequence
  Description of Artificial Sequence: Synthetic peptide
  XENP019980 vlCDR1
RASQSVGSSYLA

SEQ ID NO: 6918 - protein, 7 aa, Artificial Sequence
  Description of Artificial Sequence: Synthetic peptide
  XENP019980 vlCDR2
GAFSRAT

SEQ ID NO: 6919 - protein, 9 aa, Artificial Sequence
  Description of Artificial Sequence: Synthetic peptide
  XENP019980 vlCDR3
QQYGSSPWT

SEQ ID NO: 6920 - protein, 246 aa, Artificial Sequence
  Description of Artificial Sequence: Synthetic polypeptide
  XENP019981 [CTLA-4]_H0_L0.93_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 6921 - protein, 118 aa, Artificial Sequence; identical to SEQ ID NO: 3737
  Description of Artificial Sequence: Synthetic polypeptide
  VH of XENP019981

SEQ ID NO: 6922 - protein, 108 aa, Artificial Sequence
  Description of Artificial Sequence: Synthetic polypeptide
  VL of XENP019981
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 6923 - protein, 5 aa, Artificial Sequence
  Description of Artificial Sequence: Synthetic peptide
  XENP019981 vhCDR1
SYTMH

SEQ ID NO: 6924 - protein, 17 aa, Artificial Sequence
  Description of Artificial Sequence: Synthetic peptide
  XENP019981 vhCDR2
FISYDGNNKYYADSVKG

SEQ ID NO: 6925 - protein, 9 aa, Artificial Sequence
  Description of Artificial Sequence: Synthetic peptide
  XENP019981 vhCDR3
TGWLGPFDY

SEQ ID NO: 6926 - protein, 12 aa, Artificial Sequence
  Description of Artificial Sequence: Synthetic peptide
  XENP019981 vlCDR1
RASQSVGSSYLA

SEQ ID NO: 6927 - protein, 7 aa, Artificial Sequence
  Description of Artificial Sequence: Synthetic peptide
  XENP019981 vlCDR2
GAFSRAT

SEQ ID NO: 6928 - protein, 9 aa, Artificial Sequence
  Description of Artificial Sequence: Synthetic peptide
  XENP019981 vlCDR3
KQYGSSPWT

SEQ ID NO: 6929 - protein, 246 aa, Artificial Sequence
  Description of Artificial Sequence: Synthetic polypeptide
  XENP019982 [CTLA-4]_H0_L0.94_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 6930 - protein, 118 aa, Artificial Sequence; identical to SEQ ID NO: 3737
  Description of Artificial Sequence: Synthetic polypeptide
  VH of XENP019982

SEQ ID NO: 6931 - protein, 108 aa, Artificial Sequence
  Description of Artificial Sequence: Synthetic polypeptide
  VL of XENP019982
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 6932 - protein, 5 aa, Artificial Sequence
  Description of Artificial Sequence: Synthetic peptide
  XENP019982 vhCDR1
SYTMH

SEQ ID NO: 6933 - protein, 17 aa, Artificial Sequence
  Description of Artificial Sequence: Synthetic peptide
  XENP019982 vhCDR2
FISYDGNNKYYADSVKG

SEQ ID NO: 6934 - protein, 9 aa, Artificial Sequence
  Description of Artificial Sequence: Synthetic peptide
  XENP019982 vhCDR3
TGWLGPFDY

SEQ ID NO: 6935 - protein, 12 aa, Artificial Sequence
  Description of Artificial Sequence: Synthetic peptide
  XENP019982 vlCDR1
RASQSVGSSYLA

SEQ ID NO: 6936 - protein, 7 aa, Artificial Sequence
  Description of Artificial Sequence: Synthetic peptide
  XENP019982 vlCDR2
GAFSRAT

SEQ ID NO: 6937 - protein, 9 aa, Artificial Sequence
  Description of Artificial Sequence: Synthetic peptide
  XENP019982 vlCDR3
LQYGSSPWT

SEQ ID NO: 6938 - protein, 246 aa, Artificial Sequence
  Description of Artificial Sequence: Synthetic polypeptide
  XENP019983 [CTLA-4]_H0_L0.95_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 6939 - protein, 118 aa, Artificial Sequence; identical to SEQ ID NO: 3737
  Description of Artificial Sequence: Synthetic polypeptide
  VH of XENP019983

SEQ ID NO: 6940 - protein, 108 aa, Artificial Sequence
  Description of Artificial Sequence: Synthetic polypeptide
  VL of XENP019983
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 6941 - protein, 5 aa, Artificial Sequence
  Description of Artificial Sequence: Synthetic peptide
  XENP019983 vhCDR1
SYTMH

SEQ ID NO: 6942 - protein, 17 aa, Artificial Sequence
  Description of Artificial Sequence: Synthetic peptide
  XENP019983 vhCDR2
FISYDGNNKYYADSVKG

SEQ ID NO: 6943 - protein, 9 aa, Artificial Sequence
  Description of Artificial Sequence: Synthetic peptide
  XENP019983 vhCDR3
TGWLGPFDY

SEQ ID NO: 6944 - protein, 12 aa, Artificial Sequence
  Description of Artificial Sequence: Synthetic peptide
  XENP019983 vlCDR1
RASQSVGSSYLA

SEQ ID NO: 6945 - protein, 7 aa, Artificial Sequence
  Description of Artificial Sequence: Synthetic peptide
  XENP019983 vlCDR2
GAFSRAT

SEQ ID NO: 6946 - protein, 9 aa, Artificial Sequence
  Description of Artificial Sequence: Synthetic peptide
  XENP019983 vlCDR3
MQYGSSPWT

SEQ ID NO: 6947 - protein, 246 aa, Artificial Sequence
  Description of Artificial Sequence: Synthetic polypeptide
  XENP019984 [CTLA-4]_H0_L0.96_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 6948 - protein, 118 aa, Artificial Sequence; identical to SEQ ID NO: 3737
  Description of Artificial Sequence: Synthetic polypeptide
  VH of XENP019984

SEQ ID NO: 6949 - protein, 108 aa, Artificial Sequence
  Description of Artificial Sequence: Synthetic polypeptide
  VL of XENP019984
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 6950 - protein, 5 aa, Artificial Sequence
  Description of Artificial Sequence: Synthetic peptide
  XENP019984 vhCDR1
SYTMH

SEQ ID NO: 6951 - protein, 17 aa, Artificial Sequence
  Description of Artificial Sequence: Synthetic peptide
  XENP019984 vhCDR2
FISYDGNNKYYADSVKG

SEQ ID NO: 6952 - protein, 9 aa, Artificial Sequence
  Description of Artificial Sequence: Synthetic peptide
  XENP019984 vhCDR3
TGWLGPFDY

SEQ ID NO: 6953 - protein, 12 aa, Artificial Sequence
  Description of Artificial Sequence: Synthetic peptide
  XENP019984 vlCDR1
RASQSVGSSYLA

SEQ ID NO: 6954 - protein, 7 aa, Artificial Sequence
  Description of Artificial Sequence: Synthetic peptide
  XENP019984 vlCDR2
GAFSRAT

SEQ ID NO: 6955 - protein, 9 aa, Artificial Sequence
  Description of Artificial Sequence: Synthetic peptide
  XENP019984 vlCDR3
QSYGSSPWT

SEQ ID NO: 6956 - protein, 246 aa, Artificial Sequence
  Description of Artificial Sequence: Synthetic polypeptide
  XENP019985 [CTLA-4]_H0_L0.97_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 6957 - protein, 118 aa, Artificial Sequence; identical to SEQ ID NO: 3737
  Description of Artificial Sequence: Synthetic polypeptide
  VH of XENP019985

SEQ ID NO: 6958 - protein, 108 aa, Artificial Sequence
  Description of Artificial Sequence: Synthetic polypeptide
  VL of XENP019985
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 6959 - protein, 5 aa, Artificial Sequence
  Description of Artificial Sequence: Synthetic peptide
  XENP019985 vhCDR1
SYTMH

SEQ ID NO: 6960 - protein, 17 aa, Artificial Sequence
  Description of Artificial Sequence: Synthetic peptide
  XENP019985 vhCDR2
FISYDGNNKYYADSVKG

SEQ ID NO: 6961 - protein, 9 aa, Artificial Sequence
  Description of Artificial Sequence: Synthetic peptide
  XENP019985 vhCDR3
TGWLGPFDY

SEQ ID NO: 6962 - protein, 12 aa, Artificial Sequence
  Description of Artificial Sequence: Synthetic peptide
  XENP019985 vlCDR1
RASQSVGSSYLA

SEQ ID NO: 6963 - protein, 7 aa, Artificial Sequence
  Description of Artificial Sequence: Synthetic peptide
  XENP019985 vlCDR2
GAFSRAT

SEQ ID NO: 6964 - protein, 9 aa, Artificial Sequence
  Description of Artificial Sequence: Synthetic peptide
  XENP019985 vlCDR3
QQAGSSPWT

SEQ ID NO: 6965 - protein, 246 aa, Artificial Sequence
  Description of Artificial Sequence: Synthetic polypeptide
  XENP019986 [CTLA-4]_H0_L0.98_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 6966 - protein, 118 aa, Artificial Sequence; identical to SEQ ID NO: 3737
  Description of Artificial Sequence: Synthetic polypeptide
  VH of XENP019986

SEQ ID NO: 6967 - protein, 108 aa, Artificial Sequence
  Description of Artificial Sequence: Synthetic polypeptide
  VL of XENP019986
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 6968 - protein, 5 aa, Artificial Sequence
  Description of Artificial Sequence: Synthetic peptide
  XENP019986 vhCDR1
SYTMH

SEQ ID NO: 6969 - protein, 17 aa, Artificial Sequence
  Description of Artificial Sequence: Synthetic peptide
  XENP019986 vhCDR2
FISYDGNNKYYADSVKG

SEQ ID NO: 6970 - protein, 9 aa, Artificial Sequence
  Description of Artificial Sequence: Synthetic peptide
  XENP019986 vhCDR3
TGWLGPFDY

SEQ ID NO: 6971 - protein, 12 aa, Artificial Sequence
  Description of Artificial Sequence: Synthetic peptide
  XENP019986 vlCDR1
RASQSVGSSYLA

SEQ ID NO: 6972 - protein, 7 aa, Artificial Sequence
  Description of Artificial Sequence: Synthetic peptide
  XENP019986 vlCDR2
GAFSRAT

SEQ ID NO: 6973 - protein, 9 aa, Artificial Sequence
  Description of Artificial Sequence: Synthetic peptide
  XENP019986 vlCDR3
QQFGSSPWT

SEQ ID NO: 6974 - protein, 246 aa, Artificial Sequence
  Description of Artificial Sequence: Synthetic polypeptide
  XENP019987 [CTLA-4]_H0_L0.99_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 6975 - protein, 118 aa, Artificial Sequence; identical to SEQ ID NO: 3737
  Description of Artificial Sequence: Synthetic polypeptide
  VH of XENP019987

SEQ ID NO: 6976 - protein, 108 aa, Artificial Sequence
  Description of Artificial Sequence: Synthetic polypeptide
  VL of XENP019987
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 6977 - protein, 5 aa, Artificial Sequence
  Description of Artificial Sequence: Synthetic peptide
  XENP019987 vhCDR1
SYTMH

SEQ ID NO: 6978 - protein, 17 aa, Artificial Sequence
  Description of Artificial Sequence: Synthetic peptide
  XENP019987 vhCDR2
FISYDGNNKYYADSVKG

SEQ ID NO: 6979 - protein, 9 aa, Artificial Sequence
  Description of Artificial Sequence: Synthetic peptide
  XENP019987 vhCDR3
TGWLGPFDY

SEQ ID NO: 6980 - protein, 12 aa, Artificial Sequence
  Description of Artificial Sequence: Synthetic peptide
  XENP019987 vlCDR1
RASQSVGSSYLA

SEQ ID NO: 6981 - protein, 7 aa, Artificial Sequence
  Description of Artificial Sequence: Synthetic peptide
  XENP019987 vlCDR2
GAFSRAT

SEQ ID NO: 6982 - protein, 9 aa, Artificial Sequence
  Description of Artificial Sequence: Synthetic peptide
  XENP019987 vlCDR3
QQHGSSPWT

SEQ ID NO: 6983 - protein, 246 aa, Artificial Sequence
  Description of Artificial Sequence: Synthetic polypeptide
  XENP019988 [CTLA-4]_H0_L0.100_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 6984 - protein, 118 aa, Artificial Sequence; identical to SEQ ID NO: 3737
  Description of Artificial Sequence: Synthetic polypeptide
  VH of XENP019988

SEQ ID NO: 6985 - protein, 108 aa, Artificial Sequence
  Description of Artificial Sequence: Synthetic polypeptide
  VL of XENP019988
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 6986 - protein, 5 aa, Artificial Sequence
  Description of Artificial Sequence: Synthetic peptide
  XENP019988 vhCDR1
SYTMH

SEQ ID NO: 6987 - protein, 17 aa, Artificial Sequence
  Description of Artificial Sequence: Synthetic peptide
  XENP019988 vhCDR2
FISYDGNNKYYADSVKG

SEQ ID NO: 6988 - protein, 9 aa, Artificial Sequence
  Description of Artificial Sequence: Synthetic peptide
  XENP019988 vhCDR3
TGWLGPFDY

SEQ ID NO: 6989 - protein, 12 aa, Artificial Sequence
  Description of Artificial Sequence: Synthetic peptide
  XENP019988 vlCDR1
RASQSVGSSYLA

SEQ ID NO: 6990 - protein, 7 aa, Artificial Sequence
  Description of Artificial Sequence: Synthetic peptide
  XENP019988 vlCDR2
GAFSRAT

SEQ ID NO: 6991 - protein, 9 aa, Artificial Sequence
  Description of Artificial Sequence: Synthetic peptide
  XENP019988 vlCDR3
QQLGSSPWT

SEQ ID NO: 6992 - protein, 246 aa, Artificial Sequence
  Description of Artificial Sequence: Synthetic polypeptide
  XENP019989 [CTLA-4]_H0_L0.101_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 6993 - protein, 118 aa, Artificial Sequence; identical to SEQ ID NO: 3737
  Description of Artificial Sequence: Synthetic polypeptide
  VH of XENP019989

SEQ ID NO: 6994 - protein, 108 aa, Artificial Sequence
  Description of Artificial Sequence: Synthetic polypeptide
  VL of XENP019989
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 6995 - protein, 5 aa, Artificial Sequence
  Description of Artificial Sequence: Synthetic peptide
  XENP019989 vhCDR1
SYTMH

SEQ ID NO: 6996 - protein, 17 aa, Artificial Sequence
  Description of Artificial Sequence: Synthetic peptide
  XENP019989 vhCDR2
FISYDGNNKYYADSVKG

SEQ ID NO: 6997 - protein, 9 aa, Artificial Sequence
  Description of Artificial Sequence: Synthetic peptide
  XENP019989 vhCDR3
TGWLGPFDY

SEQ ID NO: 6998 - protein, 12 aa, Artificial Sequence
  Description of Artificial Sequence: Synthetic peptide
  XENP019989 vlCDR1
RASQSVGSSYLA

SEQ ID NO: 6999 - protein, 7 aa, Artificial Sequence
  Description of Artificial Sequence: Synthetic peptide
  XENP019989 vlCDR2
GAFSRAT

SEQ ID NO: 7000 - protein, 9 aa, Artificial Sequence
  Description of Artificial Sequence: Synthetic peptide
  XENP019989 vlCDR3
QQVGSSPWT

SEQ ID NO: 7001 - protein, 246 aa, Artificial Sequence
  Description of Artificial Sequence: Synthetic polypeptide
  XENP019990 [CTLA-4]_H0_L0.102_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 7002 - protein, 118 aa, Artificial Sequence; identical to SEQ ID NO: 3737
  Description of Artificial Sequence: Synthetic polypeptide
  VH of XENP019990

SEQ ID NO: 7003 - protein, 108 aa, Artificial Sequence
  Description of Artificial Sequence: Synthetic polypeptide
  VL of XENP019990
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 7004 - protein, 5 aa, Artificial Sequence
  Description of Artificial Sequence: Synthetic peptide
  XENP019990 vhCDR1
SYTMH

SEQ ID NO: 7005 - protein, 17 aa, Artificial Sequence
  Description of Artificial Sequence: Synthetic peptide
  XENP019990 vhCDR2
FISYDGNNKYYADSVKG

SEQ ID NO: 7006 - protein, 9 aa, Artificial Sequence
  Description of Artificial Sequence: Synthetic peptide
  XENP019990 vhCDR3
TGWLGPFDY

SEQ ID NO: 7007 - protein, 12 aa, Artificial Sequence
  Description of Artificial Sequence: Synthetic peptide
  XENP019990 vlCDR1
RASQSVGSSYLA

SEQ ID NO: 7008 - protein, 7 aa, Artificial Sequence
  Description of Artificial Sequence: Synthetic peptide
  XENP019990 vlCDR2
GAFSRAT

SEQ ID NO: 7009 - protein, 9 aa, Artificial Sequence
  Description of Artificial Sequence: Synthetic peptide
  XENP019990 vlCDR3
QQYGESPWT

SEQ ID NO: 7010 - protein, 246 aa, Artificial Sequence
  Description of Artificial Sequence: Synthetic polypeptide
  XENP019991 [CTLA-4]_H0_L0.103_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 7011 - protein, 118 aa, Artificial Sequence; identical to SEQ ID NO: 3737
  Description of Artificial Sequence: Synthetic polypeptide
  VH of XENP019991

SEQ ID NO: 7012 - protein, 108 aa, Artificial Sequence
  Description of Artificial Sequence: Synthetic polypeptide
  VL of XENP019991
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 7013 - protein, 5 aa, Artificial Sequence
  Description of Artificial Sequence: Synthetic peptide
  XENP019991 vhCDR1
SYTMH

SEQ ID NO: 7014 - protein, 17 aa, Artificial Sequence
  Description of Artificial Sequence: Synthetic peptide
  XENP019991 vhCDR2
FISYDGNNKYYADSVKG

SEQ ID NO: 7015 - protein, 9 aa, Artificial Sequence
  Description of Artificial Sequence: Synthetic peptide
  XENP019991 vhCDR3
TGWLGPFDY

SEQ ID NO: 7016 - protein, 12 aa, Artificial Sequence
  Description of Artificial Sequence: Synthetic peptide
  XENP019991 vlCDR1
RASQSVGSSYLA

SEQ ID NO: 7017 - protein, 7 aa, Artificial Sequence
  Description of Artificial Sequence: Synthetic peptide
  XENP019991 vlCDR2
GAFSRAT

SEQ ID NO: 7018 - protein, 9 aa, Artificial Sequence
  Description of Artificial Sequence: Synthetic peptide
  XENP019991 vlCDR3
QQYGKSPWT

SEQ ID NO: 7019 - protein, 246 aa, Artificial Sequence
  Description of Artificial Sequence: Synthetic polypeptide
  XENP019992 [CTLA-4]_H0_L0.104_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 7020 - protein, 118 aa, Artificial Sequence; identical to SEQ ID NO: 3737
  Description of Artificial Sequence: Synthetic polypeptide
  VH of XENP019992

SEQ ID NO: 7021 - protein, 108 aa, Artificial Sequence
  Description of Artificial Sequence: Synthetic polypeptide
  VL of XENP019992
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 7022 - protein, 5 aa, Artificial Sequence
  Description of Artificial Sequence: Synthetic peptide
  XENP019992 vhCDR1
SYTMH

SEQ ID NO: 7023 - protein, 17 aa, Artificial Sequence
  Description of Artificial Sequence: Synthetic peptide
  XENP019992 vhCDR2
FISYDGNNKYYADSVKG

SEQ ID NO: 7024 - protein, 9 aa, Artificial Sequence
  Description of Artificial Sequence: Synthetic peptide
  XENP019992 vhCDR3
TGWLGPFDY

SEQ ID NO: 7025 - protein, 12 aa, Artificial Sequence
  Description of Artificial Sequence: Synthetic peptide
  XENP019992 vlCDR1
RASQSVGSSYLA

SEQ ID NO: 7026 - protein, 7 aa, Artificial Sequence
  Description of Artificial Sequence: Synthetic peptide
  XENP019992 vlCDR2
GAFSRAT

SEQ ID NO: 7027 - protein, 9 aa, Artificial Sequence
  Description of Artificial Sequence: Synthetic peptide
  XENP019992 vlCDR3
QQYGSYPWT

SEQ ID NO: 7028 - protein, 246 aa, Artificial Sequence
  Description of Artificial Sequence: Synthetic polypeptide
  XENP019993 [CTLA-4]_H0_L0.105_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 7029 - protein, 118 aa, Artificial Sequence; identical to SEQ ID NO: 3737
  Description of Artificial Sequence: Synthetic polypeptide
  VH of XENP019993

SEQ ID NO: 7030 - protein, 108 aa, Artificial Sequence
  Description of Artificial Sequence: Synthetic polypeptide
  VL of XENP019993
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 7031 - protein, 5 aa, Artificial Sequence
  Description of Artificial Sequence: Synthetic peptide
  XENP019993 vhCDR1
SYTMH

SEQ ID NO: 7032 - protein, 17 aa, Artificial Sequence
  Description of Artificial Sequence: Synthetic peptide
  XENP019993 vhCDR2
FISYDGNNKYYADSVKG

SEQ ID NO: 7033 - protein, 9 aa, Artificial Sequence
  Description of Artificial Sequence: Synthetic peptide
  XENP019993 vhCDR3
TGWLGPFDY

SEQ ID NO: 7034 - protein, 12 aa, Artificial Sequence
  Description of Artificial Sequence: Synthetic peptide
  XENP019993 vlCDR1
RASQSVGSSYLA

SEQ ID NO: 7035 - protein, 7 aa, Artificial Sequence
  Description of Artificial Sequence: Synthetic peptide
  XENP019993 vlCDR2
GAFSRAT

SEQ ID NO: 7036 - protein, 9 aa, Artificial Sequence
  Description of Artificial Sequence: Synthetic peptide
  XENP019993 vlCDR3
QQYGSSHWT

SEQ ID NO: 7037 - protein, 246 aa, Artificial Sequence
  Description of Artificial Sequence: Synthetic polypeptide
  XENP019994 [CTLA-4]_H0_L0.106_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 7038 - protein, 118 aa, Artificial Sequence; identical to SEQ ID NO: 3737
  Description of Artificial Sequence: Synthetic polypeptide
  VH of XENP019994

SEQ ID NO: 7039 - protein, 108 aa, Artificial Sequence
  Description of Artificial Sequence: Synthetic polypeptide
  VL of XENP019994
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 7040 - protein, 5 aa, Artificial Sequence
  Description of Artificial Sequence: Synthetic peptide
  XENP019994 vhCDR1
SYTMH

SEQ ID NO: 7041 - protein, 17 aa, Artificial Sequence
  Description of Artificial Sequence: Synthetic peptide
  XENP019994 vhCDR2
FISYDGNNKYYADSVKG

SEQ ID NO: 7042 - protein, 9 aa, Artificial Sequence
  Description of Artificial Sequence: Synthetic peptide
  XENP019994 vhCDR3
TGWLGPFDY

SEQ ID NO: 7043 - protein, 12 aa, Artificial Sequence
  Description of Artificial Sequence: Synthetic peptide
  XENP019994 vlCDR1
RASQSVGSSYLA

SEQ ID NO: 7044 - protein, 7 aa, Artificial Sequence
  Description of Artificial Sequence: Synthetic peptide
  XENP019994 vlCDR2
GAFSRAT

SEQ ID NO: 7045 - protein, 9 aa, Artificial Sequence
  Description of Artificial Sequence: Synthetic peptide
  XENP019994 vlCDR3
QQYGSSPFT

SEQ ID NO: 7046 - protein, 246 aa, Artificial Sequence
  Description of Artificial Sequence: Synthetic polypeptide
  XENP019995 [CTLA-4]_H0_L0.107_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 7047 - protein, 118 aa, Artificial Sequence; identical to SEQ ID NO: 3737
  Description of Artificial Sequence: Synthetic polypeptide
  VH of XENP019995

SEQ ID NO: 7048 - protein, 108 aa, Artificial Sequence
  Description of Artificial Sequence: Synthetic polypeptide
  VL of XENP019995
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 7049 - protein, 5 aa, Artificial Sequence
  Description of Artificial Sequence: Synthetic peptide
  XENP019995 vhCDR1
SYTMH

SEQ ID NO: 7050 - protein, 17 aa, Artificial Sequence
  Description of Artificial Sequence: Synthetic peptide
  XENP019995 vhCDR2
FISYDGNNKYYADSVKG

SEQ ID NO: 7051 - protein, 9 aa, Artificial Sequence
  Description of Artificial Sequence: Synthetic peptide
  XENP019995 vhCDR3
TGWLGPFDY

SEQ ID NO: 7052 - protein, 12 aa, Artificial Sequence
  Description of Artificial Sequence: Synthetic peptide
  XENP019995 vlCDR1
RASQSVGSSYLA

SEQ ID NO: 7053 - protein, 7 aa, Artificial Sequence
  Description of Artificial Sequence: Synthetic peptide
  XENP019995 vlCDR2
GAFSRAT

SEQ ID NO: 7054 - protein, 9 aa, Artificial Sequence
  Description of Artificial Sequence: Synthetic peptide
  XENP019995 vlCDR3
QQYGSSPHT

SEQ ID NO: 7055 - protein, 246 aa, Artificial Sequence
  Description of Artificial Sequence: Synthetic polypeptide
  XENP019996 [CTLA-4]_H0_L0.108_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 7056 - protein, 118 aa, Artificial Sequence; identical to SEQ ID NO: 3737
  Description of Artificial Sequence: Synthetic polypeptide
  VH of XENP019996

SEQ ID NO: 7057 - protein, 108 aa, Artificial Sequence
  Description of Artificial Sequence: Synthetic polypeptide
  VL of XENP019996
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 7058 - protein, 5 aa, Artificial Sequence
  Description of Artificial Sequence: Synthetic peptide
  XENP019996 vhCDR1
SYTMH

SEQ ID NO: 7059 - protein, 17 aa, Artificial Sequence
  Description of Artificial Sequence: Synthetic peptide
  XENP019996 vhCDR2
FISYDGNNKYYADSVKG

SEQ ID NO: 7060 - protein, 9 aa, Artificial Sequence
  Description of Artificial Sequence: Synthetic peptide
  XENP019996 vhCDR3
TGWLGPFDY

SEQ ID NO: 7061 - protein, 12 aa, Artificial Sequence
  Description of Artificial Sequence: Synthetic peptide
  XENP019996 vlCDR1
RASQSVGSSYLA

SEQ ID NO: 7062 - protein, 7 aa, Artificial Sequence
  Description of Artificial Sequence: Synthetic peptide
  XENP019996 vlCDR2
GAFSRAT

SEQ ID NO: 7063 - protein, 9 aa, Artificial Sequence
  Description of Artificial Sequence: Synthetic peptide
  XENP019996 vlCDR3
QQYGSSPIT

SEQ ID NO: 7064 - protein, 246 aa, Artificial Sequence
  Description of Artificial Sequence: Synthetic polypeptide
  XENP020001 [CTLA-4]_H0_L0.109_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 7065 - protein, 118 aa, Artificial Sequence; identical to SEQ ID NO: 3737
  Description of Artificial Sequence: Synthetic polypeptide
  VH of XENP020001

SEQ ID NO: 7066 - protein, 108 aa, Artificial Sequence
  Description of Artificial Sequence: Synthetic polypeptide
  VL of XENP020001
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 7067 - protein, 5 aa, Artificial Sequence
  Description of Artificial Sequence: Synthetic peptide
  XENP020001 vhCDR1
SYTMH

SEQ ID NO: 7068 - protein, 17 aa, Artificial Sequence
  Description of Artificial Sequence: Synthetic peptide
  XENP020001 vhCDR2
FISYDGNNKYYADSVKG

SEQ ID NO: 7069 - protein, 9 aa, Artificial Sequence
  Description of Artificial Sequence: Synthetic peptide
  XENP020001 vhCDR3
TGWLGPFDY

SEQ ID NO: 7070 - protein, 12 aa, Artificial Sequence
  Description of Artificial Sequence: Synthetic peptide
  XENP020001 vlCDR1
RASQSVGSSYLA

SEQ ID NO: 7071 - protein, 7 aa, Artificial Sequence
  Description of Artificial Sequence: Synthetic peptide
  XENP020001 vlCDR2
GAFSRAT

SEQ ID NO: 7072 - protein, 9 aa, Artificial Sequence
  Description of Artificial Sequence: Synthetic peptide
  XENP020001 vlCDR3
QQYGSSPLT

SEQ ID NO: 7073 - protein, 246 aa, Artificial Sequence
  Description of Artificial Sequence: Synthetic polypeptide
  XENP020002 [CTLA-4]_H0_L0.110_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 7074 - protein, 118 aa, Artificial Sequence; identical to SEQ ID NO: 3737
  Description of Artificial Sequence: Synthetic polypeptide
  VH of XENP020002

SEQ ID NO: 7075 - protein, 108 aa, Artificial Sequence
  Description of Artificial Sequence: Synthetic polypeptide
  VL of XENP020002
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 7076 - protein, 5 aa, Artificial Sequence
  Description of Artificial Sequence: Synthetic peptide
  XENP020002 vhCDR1
SYTMH

SEQ ID NO: 7077 - protein, 17 aa, Artificial Sequence
  Description of Artificial Sequence: Synthetic peptide
  XENP020002 vhCDR2
FISYDGNNKYYADSVKG

SEQ ID NO: 7078 - protein, 9 aa, Artificial Sequence
  Description of Artificial Sequence: Synthetic peptide
  XENP020002 vhCDR3
TGWLGPFDY

SEQ ID NO: 7079 - protein, 12 aa, Artificial Sequence
  Description of Artificial Sequence: Synthetic peptide
  XENP020002 vlCDR1
RASQSVGSSYLA

SEQ ID NO: 7080 - protein, 7 aa, Artificial Sequence
  Description of Artificial Sequence: Synthetic peptide
  XENP020002 vlCDR2
GAFSRAT

SEQ ID NO: 7081 - protein, 9 aa, Artificial Sequence
  Description of Artificial Sequence: Synthetic peptide
  XENP020002 vlCDR3
QQYGSSPYT

SEQ ID NO: 7082 - protein, 246 aa, Artificial Sequence
  Description of Artificial Sequence: Synthetic polypeptide
  XENP020003 [CTLA-4]_H0_L0.111_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 7083 - protein, 118 aa, Artificial Sequence; identical to SEQ ID NO: 3737
  Description of Artificial Sequence: Synthetic polypeptide
  VH of XENP020003

SEQ ID NO: 7084 - protein, 108 aa, Artificial Sequence
  Description of Artificial Sequence: Synthetic polypeptide
  VL of XENP020003
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 7085 - protein, 5 aa, Artificial Sequence
  Description of Artificial Sequence: Synthetic peptide
  XENP020003 vhCDR1
SYTMH

SEQ ID NO: 7086 - protein, 17 aa, Artificial Sequence
  Description of Artificial Sequence: Synthetic peptide
  XENP020003 vhCDR2
FISYDGNNKYYADSVKG

SEQ ID NO: 7087 - protein, 9 aa, Artificial Sequence
  Description of Artificial Sequence: Synthetic peptide
  XENP020003 vhCDR3
TGWLGPFDY

SEQ ID NO: 7088 - protein, 12 aa, Artificial Sequence
  Description of Artificial Sequence: Synthetic peptide
  XENP020003 vlCDR1
RASQSVGSSYLA

SEQ ID NO: 7089 - protein, 7 aa, Artificial Sequence
  Description of Artificial Sequence: Synthetic peptide
  XENP020003 vlCDR2
GAFSRAT

SEQ ID NO: 7090 - protein, 9 aa, Artificial Sequence
  Description of Artificial Sequence: Synthetic peptide
  XENP020003 vlCDR3
QQYGSSPWV

SEQ ID NO: 7091 - protein, 246 aa, Artificial Sequence
  Description of Artificial Sequence: Synthetic polypeptide
  XENP020004 [CTLA-4]_H0_L0.112_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 7092 - protein, 118 aa, Artificial Sequence; identical to SEQ ID NO: 3737
  Description of Artificial Sequence: Synthetic polypeptide
  VH of XENP020004

SEQ ID NO: 7093 - protein, 108 aa, Artificial Sequence
  Description of Artificial Sequence: Synthetic polypeptide
  VL of XENP020004
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 7094 - protein, 5 aa, Artificial Sequence
  Description of Artificial Sequence: Synthetic peptide
  XENP020004 vhCDR1
SYTMH

SEQ ID NO: 7095 - protein, 17 aa, Artificial Sequence
  Description of Artificial Sequence: Synthetic peptide
  XENP020004 vhCDR2
FISYDGNNKYYADSVKG

SEQ ID NO: 7096 - protein, 9 aa, Artificial Sequence
  Description of Artificial Sequence: Synthetic peptide
  XENP020004 vhCDR3
TGWLGPFDY

SEQ ID NO: 7097 - protein, 12 aa, Artificial Sequence
  Description of Artificial Sequence: Synthetic peptide
  XENP020004 vlCDR1
RASQSVGSSYLA

SEQ ID NO: 7098 - protein, 7 aa, Artificial Sequence
  Description of Artificial Sequence: Synthetic peptide
  XENP020004 vlCDR2
GAFSRAT

SEQ ID NO: 7099 - protein, 9 aa, Artificial Sequence
  Description of Artificial Sequence: Synthetic peptide
  XENP020004 vlCDR3
QQYGSSPWT

SEQ ID NO: 7100 - protein, 246 aa, Artificial Sequence
  Description of Artificial Sequence: Synthetic polypeptide
  XENP020005 [CTLA-4]_H0_L0.113_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 7101 - protein, 118 aa, Artificial Sequence; identical to SEQ ID NO: 3737
  Description of Artificial Sequence: Synthetic polypeptide
  VH of XENP020005

SEQ ID NO: 7102 - protein, 108 aa, Artificial Sequence; identical to SEQ ID NO: 4735
  Description of Artificial Sequence: Synthetic polypeptide
  VL of XENP020005

SEQ ID NO: 7103 - protein, 5 aa, Artificial Sequence
  Description of Artificial Sequence: Synthetic peptide
  XENP020005 vhCDR1
SYTMH

SEQ ID NO: 7104 - protein, 17 aa, Artificial Sequence
  Description of Artificial Sequence: Synthetic peptide
  XENP020005 vhCDR2
FISYDGNNKYYADSVKG

SEQ ID NO: 7105 - protein, 9 aa, Artificial Sequence
  Description of Artificial Sequence: Synthetic peptide
  XENP020005 vhCDR3
TGWLGPFDY

SEQ ID NO: 7106 - protein, 12 aa, Artificial Sequence
  Description of Artificial Sequence: Synthetic peptide
  XENP020005 vlCDR1
RASQSVGSSYLA

SEQ ID NO: 7107 - protein, 7 aa, Artificial Sequence
  Description of Artificial Sequence: Synthetic peptide
  XENP020005 vlCDR2
GAFSRAT

SEQ ID NO: 7108 - protein, 9 aa, Artificial Sequence
  Description of Artificial Sequence: Synthetic peptide
  XENP020005 vlCDR3
QQYGSSPWT

SEQ ID NO: 7109 - protein, 246 aa, Artificial Sequence
  Description of Artificial Sequence: Synthetic polypeptide
  XENP020075 [CTLA-4]_H3.1_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7110 - protein, 118 aa, Artificial Sequence
  Description of Artificial Sequence: Synthetic polypeptide
  VH of XENP020075
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSS

SEQ ID NO: 7111 - protein, 108 aa, Artificial Sequence; identical to SEQ ID NO: 6193
  Description of Artificial Sequence: Synthetic polypeptide
  VL of XENP020075

SEQ ID NO: 7112 - protein, 5 aa, Artificial Sequence
  Description of Artificial Sequence: Synthetic peptide
  XENP020075 vhCDR1
SYTMH

SEQ ID NO: 7113 - protein, 17 aa, Artificial Sequence
  Description of Artificial Sequence: Synthetic peptide
  XENP020075 vhCDR2
FISYDGNHKYYADSVKG

SEQ ID NO: 7114 - protein, 9 aa, Artificial Sequence
  Description of Artificial Sequence: Synthetic peptide
  XENP020075 vhCDR3
TGLLGPFDL

SEQ ID NO: 7115 - protein, 12 aa, Artificial Sequence
  Description of Artificial Sequence: Synthetic peptide
  XENP020075 vlCDR1
RASQSVGSSYLA

SEQ ID NO: 7116 - protein, 7 aa, Artificial Sequence
  Description of Artificial Sequence: Synthetic peptide
  XENP020075 vlCDR2
GAFSRAT

SEQ ID NO: 7117 - protein, 9 aa, Artificial Sequence
  Description of Artificial Sequence: Synthetic peptide
  XENP020075 vlCDR3
QQYGSSPWT

SEQ ID NO: 7118 - protein, 246 aa, Artificial Sequence
  Description of Artificial Sequence: Synthetic polypeptide
  XENP020076 [CTLA-4]_H3.2_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7119 - protein, 118 aa, Artificial Sequence
  Description of Artificial Sequence: Synthetic polypeptide
  VH of XENP020076
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSS

SEQ ID NO: 7120 - protein, 108 aa, Artificial Sequence; identical to SEQ ID NO: 6193
  Description of Artificial Sequence: Synthetic polypeptide
  VL of XENP020076

SEQ ID NO: 7121 - protein, 5 aa, Artificial Sequence
  Description of Artificial Sequence: Synthetic peptide
  XENP020076 vhCDR1
SYTMH

SEQ ID NO: 7122 - protein, 17 aa, Artificial Sequence
  Description of Artificial Sequence: Synthetic peptide
  XENP020076 vhCDR2
FISYDGNTKYYADSVKG

SEQ ID NO: 7123 - protein, 9 aa, Artificial Sequence
  Description of Artificial Sequence: Synthetic peptide
  XENP020076 vhCDR3
TGLLGPFDL

SEQ ID NO: 7124 - protein, 12 aa, Artificial Sequence
  Description of Artificial Sequence: Synthetic peptide
  XENP020076 vlCDR1
RASQSVGSSYLA

SEQ ID NO: 7125 - protein, 7 aa, Artificial Sequence
  Description of Artificial Sequence: Synthetic peptide
  XENP020076 vlCDR2
GAFSRAT

SEQ ID NO: 7126 - protein, 9 aa, Artificial Sequence
  Description of Artificial Sequence: Synthetic peptide
  XENP020076 vlCDR3
QQYGSSPWT

SEQ ID NO: 7127 - protein, 246 aa, Artificial Sequence
  Description of Artificial Sequence: Synthetic polypeptide
  XENP020077 [CTLA-4]_H3.3_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7128 - protein, 118 aa, Artificial Sequence
  Description of Artificial Sequence: Synthetic polypeptide
  VH of XENP020077
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSS

SEQ ID NO: 7129 - protein, 108 aa, Artificial Sequence; identical to SEQ ID NO: 6193
  Description of Artificial Sequence: Synthetic polypeptide
  VL of XENP020077

SEQ ID NO: 7130 - protein, 5 aa, Artificial Sequence
  Description of Artificial Sequence: Synthetic peptide
  XENP020077 vhCDR1
SYTMH

SEQ ID NO: 7131 - protein, 17 aa, Artificial Sequence
  Description of Artificial Sequence: Synthetic peptide
  XENP020077 vhCDR2
FISYDGNQKYYADSVKG

SEQ ID NO: 7132 - protein, 9 aa, Artificial Sequence
  Description of Artificial Sequence: Synthetic peptide
  XENP020077 vhCDR3
TGLLGPFDL

SEQ ID NO: 7133 - protein, 12 aa, Artificial Sequence
  Description of Artificial Sequence: Synthetic peptide
  XENP020077 vlCDR1
RASQSVGSSYLA

SEQ ID NO: 7134 - protein, 7 aa, Artificial Sequence
  Description of Artificial Sequence: Synthetic peptide
  XENP020077 vlCDR2
GAFSRAT

SEQ ID NO: 7135 - protein, 9 aa, Artificial Sequence
  Description of Artificial Sequence: Synthetic peptide
  XENP020077 vlCDR3
QQYGSSPWT

SEQ ID NO: 7136 - protein, 246 aa, Artificial Sequence
  Description of Artificial Sequence: Synthetic polypeptide
  XENP020078 [CTLA-4]_H3.4_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7137 - protein, 118 aa, Artificial Sequence
  Description of Artificial Sequence: Synthetic polypeptide
  VH of XENP020078
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS

SEQ ID NO: 7138 - protein, 108 aa, Artificial Sequence; identical to SEQ ID NO: 6193
  Description of Artificial Sequence: Synthetic polypeptide
  VL of XENP020078

SEQ ID NO: 7139 - protein, 5 aa, Artificial Sequence
  Description of Artificial Sequence: Synthetic peptide
  XENP020078 vhCDR1
SYTMH

SEQ ID NO: 7140 - protein, 17 aa, Artificial Sequence
  Description of Artificial Sequence: Synthetic peptide
  XENP020078 vhCDR2
FISYDGNHKYYADSVKG

SEQ ID NO: 7141 - protein, 9 aa, Artificial Sequence
  Description of Artificial Sequence: Synthetic peptide
  XENP020078 vhCDR3
TGHLGPFDL

SEQ ID NO: 7142 - protein, 12 aa, Artificial Sequence
  Description of Artificial Sequence: Synthetic peptide
  XENP020078 vlCDR1
RASQSVGSSYLA

SEQ ID NO: 7143 - protein, 7 aa, Artificial Sequence
  Description of Artificial Sequence: Synthetic peptide
  XENP020078 vlCDR2
GAFSRAT

SEQ ID NO: 7144 - protein, 9 aa, Artificial Sequence
  Description of Artificial Sequence: Synthetic peptide
  XENP020078 vlCDR3
QQYGSSPWT

SEQ ID NO: 7145 - protein, 246 aa, Artificial Sequence
  Description of Artificial Sequence: Synthetic polypeptide
  XENP020079 [CTLA-4]_H3.5_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7146 - protein, 118 aa, Artificial Sequence
  Description of Artificial Sequence: Synthetic polypeptide
  VH of XENP020079
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS

SEQ ID NO: 7147 - protein, 108 aa, Artificial Sequence; identical to SEQ ID NO: 6193
  Description of Artificial Sequence: Synthetic polypeptide
  VL of XENP020079

SEQ ID NO: 7148 - protein, 5 aa, Artificial Sequence
  Description of Artificial Sequence: Synthetic peptide
  XENP020079 vhCDR1
SYTMH

SEQ ID NO: 7149 - protein, 17 aa, Artificial Sequence
  Description of Artificial Sequence: Synthetic peptide
  XENP020079 vhCDR2
FISYDGNTKYYADSVKG

SEQ ID NO: 7150 - protein, 9 aa, Artificial Sequence
  Description of Artificial Sequence: Synthetic peptide
  XENP020079 vhCDR3
TGHLGPFDL

SEQ ID NO: 7151 - protein, 12 aa, Artificial Sequence
  Description of Artificial Sequence: Synthetic peptide
  XENP020079 vlCDR1
RASQSVGSSYLA

SEQ ID NO: 7152 - protein, 7 aa, Artificial Sequence
  Description of Artificial Sequence: Synthetic peptide
  XENP020079 vlCDR2
GAFSRAT

SEQ ID NO: 7153 - protein, 9 aa, Artificial Sequence
  Description of Artificial Sequence: Synthetic peptide
  XENP020079 vlCDR3
QQYGSSPWT

SEQ ID NO: 7154 - protein, 246 aa, Artificial Sequence
  Description of Artificial Sequence: Synthetic polypeptide
  XENP020080 [CTLA-4]_H3.6_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7155 - protein, 118 aa, Artificial Sequence
  Description of Artificial Sequence: Synthetic polypeptide
  VH of XENP020080
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSS

SEQ ID NO: 7156 - protein, 108 aa, Artificial Sequence; identical to SEQ ID NO: 6193
  Description of Artificial Sequence: Synthetic polypeptide
  VL of XENP020080

SEQ ID NO: 7157 - protein, 5 aa, Artificial Sequence
  Description of Artificial Sequence: Synthetic peptide
  XENP020080 vhCDR1
SYTMH

SEQ ID NO: 7158 - protein, 17 aa, Artificial Sequence
  Description of Artificial Sequence: Synthetic peptide
  XENP020080 vhCDR2
FISYDGNQKYYADSVKG

SEQ ID NO: 7159 - protein, 9 aa, Artificial Sequence
  Description of Artificial Sequence: Synthetic peptide
  XENP020080 vhCDR3
TGHLGPFDL

SEQ ID NO: 7160 - protein, 12 aa, Artificial Sequence
  Description of Artificial Sequence: Synthetic peptide
  XENP020080 vlCDR1
RASQSVGSSYLA

SEQ ID NO: 7161 - protein, 7 aa, Artificial Sequence
  Description of Artificial Sequence: Synthetic peptide
  XENP020080 vlCDR2
GAFSRAT

SEQ ID NO: 7162 - protein, 9 aa, Artificial Sequence
  Description of Artificial Sequence: Synthetic peptide
  XENP020080 vlCDR3
QQYGSSPWT

SEQ ID NO: 7163 - protein, 246 aa, Artificial Sequence
  Description of Artificial Sequence: Synthetic polypeptide
  XENP020081 [CTLA-4]_H3.7_L0.12_scFv(GKPGS)4
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7164 - protein, 118 aa, Artificial Sequence
  Description of Artificial Sequence: Synthetic polypeptide
  VH of XENP020081
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSS

SEQ ID NO: 7165 - protein, 108 aa, Artificial Sequence; identical to SEQ ID NO: 6193
  Description of Artificial Sequence: Synthetic polypeptide
  VL of XENP020081

SEQ ID NO: 7166 - protein, 5 aa, Artificial Sequence
  Description of Artificial Sequence: Synthetic peptide
  XENP020081 vhCDR1
SYTMH

SEQ ID NO: 7167 - protein, 17 aa, Artificial Sequence
  Description of Artificial Sequence: Synthetic peptide
  XENP020081 vhCDR2
FISYDGNNKYYADSVKG

SEQ ID NO: 7168 - protein, 9 aa, Artificial Sequence
  Description of Artificial Sequence: Synthetic peptide
  XENP020081 vhCDR3
TGWLGPFDY

SEQ ID NO: 7169 - protein, 12 aa, Artificial Sequence
  Description of Artificial Sequence: Synthetic peptide
  XENP020081 vlCDR1
RASQSVGSSYLA

SEQ ID NO: 7170 - protein, 7 aa, Artificial Sequence
  Description of Artificial Sequence: Synthetic peptide
  XENP020081 vlCDR2
GAFSRAT

SEQ ID NO: 7171 - protein, 9 aa, Artificial Sequence
  Description of Artificial Sequence: Synthetic peptide
  XENP020081 vlCDR3
QQYGSSPWT

SEQ ID NO: 7172 - protein, 246 aa, Artificial Sequence
  Description of Artificial Sequence: Synthetic polypeptide
  XENP020082 [CTLA-4]_H3.8_L0.12_scFv(GKPGS)4
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7173 - protein, 118 aa, Artificial Sequence
  Description of Artificial Sequence: Synthetic polypeptide
  VH of XENP020082
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSS

SEQ ID NO: 7174 - protein, 108 aa, Artificial Sequence; identical to SEQ ID NO: 6193
  Description of Artificial Sequence: Synthetic polypeptide
  VL of XENP020082

SEQ ID NO: 7175 - protein, 5 aa, Artificial Sequence
  Description of Artificial Sequence: Synthetic peptide
  XENP020082 vhCDR1
SYTMH

SEQ ID NO: 7176 - protein, 17 aa, Artificial Sequence
  Description of Artificial Sequence: Synthetic peptide
  XENP020082 vhCDR2
FISYDGNNKYYADSVKG

SEQ ID NO: 7177 - protein, 9 aa, Artificial Sequence
  Description of Artificial Sequence: Synthetic peptide
  XENP020082 vhCDR3
TGWLGPFDY

SEQ ID NO: 7178 - protein, 12 aa, Artificial Sequence
  Description of Artificial Sequence: Synthetic peptide
  XENP020082 vlCDR1
RASQSVGSSYLA

SEQ ID NO: 7179 - protein, 7 aa, Artificial Sequence
  Description of Artificial Sequence: Synthetic peptide
  XENP020082 vlCDR2
GAFSRAT

SEQ ID NO: 7180 - protein, 9 aa, Artificial Sequence
  Description of Artificial Sequence: Synthetic peptide
  XENP020082 vlCDR3
QQYGSSPWT

SEQ ID NO: 7181 - protein, 246 aa, Artificial Sequence
  Description of Artificial Sequence: Synthetic polypeptide
  XENP020360 [CTLA-4]_H3.9_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7182 - protein, 118 aa, Artificial Sequence
  Description of Artificial Sequence: Synthetic polypeptide
  VH of XENP020360
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSS

SEQ ID NO: 7183 - protein, 108 aa, Artificial Sequence; identical to SEQ ID NO: 6193
  Description of Artificial Sequence: Synthetic polypeptide
  VL of XENP020360

SEQ ID NO: 7184 - protein, 5 aa, Artificial Sequence
  Description of Artificial Sequence: Synthetic peptide
  XENP020360 vhCDR1
SYTMH

SEQ ID NO: 7185 - protein, 17 aa, Artificial Sequence
  Description of Artificial Sequence: Synthetic peptide
  XENP020360 vhCDR2
FISYDGNYKYYADSVKG

SEQ ID NO: 7186 - protein, 9 aa, Artificial Sequence
  Description of Artificial Sequence: Synthetic peptide
  XENP020360 vhCDR3
TGHLGPFDL

SEQ ID NO: 7187 - protein, 12 aa, Artificial Sequence
  Description of Artificial Sequence: Synthetic peptide
  XENP020360 vlCDR1
RASQSVGSSYLA

SEQ ID NO: 7188 - protein, 7 aa, Artificial Sequence
  Description of Artificial Sequence: Synthetic peptide
  XENP020360 vlCDR2
GAFSRAT

SEQ ID NO: 7189 - protein, 9 aa, Artificial Sequence
  Description of Artificial Sequence: Synthetic peptide
  XENP020360 vlCDR3
QQYGSSPWT

SEQ ID NO: 7190 - protein, 246 aa, Artificial Sequence
  Description of Artificial Sequence: Synthetic polypeptide
  XENP020361 [CTLA-4]_H3.10_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7191 - protein, 118 aa, Artificial Sequence
  Description of Artificial Sequence: Synthetic polypeptide
  VH of XENP020361
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSS

SEQ ID NO: 7192 - protein, 108 aa, Artificial Sequence; identical to SEQ ID NO: 6193
  Description of Artificial Sequence: Synthetic polypeptide
  VL of XENP020361

SEQ ID NO: 7193 - protein, 5 aa, Artificial Sequence
  Description of Artificial Sequence: Synthetic peptide
  XENP020361 vhCDR1
SYTMH

SEQ ID NO: 7194 - protein, 17 aa, Artificial Sequence
  Description of Artificial Sequence: Synthetic peptide
  XENP020361 vhCDR2
FISYDGNYKYYADSVKG

SEQ ID NO: 7195 - protein, 9 aa, Artificial Sequence
  Description of Artificial Sequence: Synthetic peptide
  XENP020361 vhCDR3
TGLLGPFDL

SEQ ID NO: 7196 - protein, 12 aa, Artificial Sequence
  Description of Artificial Sequence: Synthetic peptide
  XENP020361 vlCDR1
RASQSVGSSYLA

SEQ ID NO: 7197 - protein, 7 aa, Artificial Sequence
  Description of Artificial Sequence: Synthetic peptide
  XENP020361 vlCDR2
GAFSRAT

SEQ ID NO: 7198 - protein, 9 aa, Artificial Sequence
  Description of Artificial Sequence: Synthetic peptide
  XENP020361 vlCDR3
QQYGSSPWT

SEQ ID NO: 7199 - protein, 246 aa, Artificial Sequence
  Description of Artificial Sequence: Synthetic polypeptide
  XENP020362 [CTLA-4]_H3.11_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7200 - protein, 118 aa, Artificial Sequence
  Description of Artificial Sequence: Synthetic polypeptide
  VH of XENP020362
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSS

SEQ ID NO: 7201 - protein, 108 aa, Artificial Sequence; identical to SEQ ID NO: 6193
  Description of Artificial Sequence: Synthetic polypeptide
  VL of XENP020362

SEQ ID NO: 7202 - protein, 5 aa, Artificial Sequence
  Description of Artificial Sequence: Synthetic peptide
  XENP020362 vhCDR1
SYTMH

SEQ ID NO: 7203 - protein, 17 aa, Artificial Sequence
  Description of Artificial Sequence: Synthetic peptide
  XENP020362 vhCDR2
FISYDGNHKYYADSVKG

SEQ ID NO: 7204 - protein, 9 aa, Artificial Sequence
  Description of Artificial Sequence: Synthetic peptide
  XENP020362 vhCDR3
GGHLGPFDL

SEQ ID NO: 7205 - protein, 12 aa, Artificial Sequence
  Description of Artificial Sequence: Synthetic peptide
  XENP020362 vlCDR1
RASQSVGSSYLA

SEQ ID NO: 7206 - protein, 7 aa, Artificial Sequence
  Description of Artificial Sequence: Synthetic peptide
  XENP020362 vlCDR2
GAFSRAT

SEQ ID NO: 7207 - protein, 9 aa, Artificial Sequence
  Description of Artificial Sequence: Synthetic peptide
  XENP020362 vlCDR3
QQYGSSPWT

SEQ ID NO: 7208 - protein, 246 aa, Artificial Sequence
  Description of Artificial Sequence: Synthetic polypeptide
  XENP020363 [CTLA-4]_H3.12_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7209 - protein, 118 aa, Artificial Sequence
  Description of Artificial Sequence: Synthetic polypeptide
  VH of XENP020363
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSS

SEQ ID NO: 7210 - protein, 108 aa, Artificial Sequence; identical to SEQ ID NO: 6193
  Description of Artificial Sequence: Synthetic polypeptide
  VL of XENP020363

SEQ ID NO: 7211 - protein, 5 aa, Artificial Sequence
  Description of Artificial Sequence: Synthetic peptide
  XENP020363 vhCDR1
SYTMH

SEQ ID NO: 7212 - protein, 17 aa, Artificial Sequence
  Description of Artificial Sequence: Synthetic peptide
  XENP020363 vhCDR2
FISYDGNHKYYADSVKG

SEQ ID NO: 7213 - protein, 9 aa, Artificial Sequence
  Description of Artificial Sequence: Synthetic peptide
  XENP020363 vhCDR3
TSHLGPFDL

SEQ ID NO: 7214 - protein, 12 aa, Artificial Sequence
  Description of Artificial Sequence: Synthetic peptide
  XENP020363 vlCDR1
RASQSVGSSYLA

SEQ ID NO: 7215 - protein, 7 aa, Artificial Sequence
  Description of Artificial Sequence: Synthetic peptide
  XENP020363 vlCDR2
GAFSRAT

SEQ ID NO: 7216 - protein, 9 aa, Artificial Sequence
  Description of Artificial Sequence: Synthetic peptide
  XENP020363 vlCDR3
QQYGSSPWT

SEQ ID NO: 7217 - protein, 246 aa, Artificial Sequence
  Description of Artificial Sequence: Synthetic polypeptide
  XENP020364 [CTLA-4]_H3.13_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7218 - protein, 118 aa, Artificial Sequence
  Description of Artificial Sequence: Synthetic polypeptide
  VH of XENP020364
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSS

SEQ ID NO: 7219 - protein, 108 aa, Artificial Sequence; identical to SEQ ID NO: 6193
  Description of Artificial Sequence: Synthetic polypeptide
  VL of XENP020364

SEQ ID NO: 7220 - protein, 5 aa, Artificial Sequence
  Description of Artificial Sequence: Synthetic peptide
  XENP020364 vhCDR1
SYTMH

SEQ ID NO: 7221 - protein, 17 aa, Artificial Sequence
  Description of Artificial Sequence: Synthetic peptide
  XENP020364 vhCDR2
FISYDGNHKYYADSVKG

SEQ ID NO: 7222 - protein, 9 aa, Artificial Sequence
  Description of Artificial Sequence: Synthetic peptide
  XENP020364 vhCDR3
GGLLGPFDL

SEQ ID NO: 7223 - protein, 12 aa, Artificial Sequence
  Description of Artificial Sequence: Synthetic peptide
  XENP020364 vlCDR1
RASQSVGSSYLA

SEQ ID NO: 7224 - protein, 7 aa, Artificial Sequence
  Description of Artificial Sequence: Synthetic peptide
  XENP020364 vlCDR2
GAFSRAT

SEQ ID NO: 7225 - protein, 9 aa, Artificial Sequence
  Description of Artificial Sequence: Synthetic peptide
  XENP020364 vlCDR3
QQYGSSPWT

SEQ ID NO: 7226 - protein, 246 aa, Artificial Sequence
  Description of Artificial Sequence: Synthetic polypeptide
  XENP020365 [CTLA-4]_H3.14_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7227 - protein, 118 aa, Artificial Sequence
  Description of Artificial Sequence: Synthetic polypeptide
  VH of XENP020365
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSS

SEQ ID NO: 7228 - protein, 108 aa, Artificial Sequence; identical to SEQ ID NO: 6193
  Description of Artificial Sequence: Synthetic polypeptide
  VL of XENP020365

SEQ ID NO: 7229 - protein, 5 aa, Artificial Sequence
  Description of Artificial Sequence: Synthetic peptide
  XENP020365 vhCDR1
SYTMH

SEQ ID NO: 7230 - protein, 17 aa, Artificial Sequence
  Description of Artificial Sequence: Synthetic peptide
  XENP020365 vhCDR2
FISYDGNHKYYADSVKG

SEQ ID NO: 7231 - protein, 9 aa, Artificial Sequence
  Description of Artificial Sequence: Synthetic peptide
  XENP020365 vhCDR3
TSLLGPFDL

SEQ ID NO: 7232 - protein, 12 aa, Artificial Sequence
  Description of Artificial Sequence: Synthetic peptide
  XENP020365 vlCDR1
RASQSVGSSYLA

SEQ ID NO: 7233 - protein, 7 aa, Artificial Sequence
  Description of Artificial Sequence: Synthetic peptide
  XENP020365 vlCDR2
GAFSRAT

SEQ ID NO: 7234 - protein, 9 aa, Artificial Sequence
  Description of Artificial Sequence: Synthetic peptide
  XENP020365 vlCDR3
QQYGSSPWT

SEQ ID NO: 7235 - protein, 246 aa, Artificial Sequence
  Description of Artificial Sequence: Synthetic polypeptide
  XENP020366 [CTLA-4]_H3.15_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7236 - protein, 118 aa, Artificial Sequence
  Description of Artificial Sequence: Synthetic polypeptide
  VH of XENP020366
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSS

SEQ ID NO: 7237 - protein, 108 aa, Artificial Sequence; identical to SEQ ID NO: 6193
  Description of Artificial Sequence: Synthetic polypeptide
  VL of XENP020366

SEQ ID NO: 7238 - protein, 5 aa, Artificial Sequence
  Description of Artificial Sequence: Synthetic peptide
  XENP020366 vhCDR1
SYTMH

SEQ ID NO: 7239 - protein, 17 aa, Artificial Sequence
  Description of Artificial Sequence: Synthetic peptide
  XENP020366 vhCDR2
FISYDGNQKYYADSVKG

SEQ ID NO: 7240 - protein, 9 aa, Artificial Sequence
  Description of Artificial Sequence: Synthetic peptide
  XENP020366 vhCDR3
GGHLGPFDL

SEQ ID NO: 7241 - protein, 12 aa, Artificial Sequence
  Description of Artificial Sequence: Synthetic peptide
  XENP020366 vlCDR1
RASQSVGSSYLA

SEQ ID NO: 7242 - protein, 7 aa, Artificial Sequence
  Description of Artificial Sequence: Synthetic peptide
  XENP020366 vlCDR2
GAFSRAT

SEQ ID NO: 7243 - protein, 9 aa, Artificial Sequence
  Description of Artificial Sequence: Synthetic peptide
  XENP020366 vlCDR3
QQYGSSPWT

SEQ ID NO: 7244 - protein, 246 aa, Artificial Sequence
  Description of Artificial Sequence: Synthetic polypeptide
  XENP020367 [CTLA-4]_H3.16_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7245 - protein, 118 aa, Artificial Sequence
  Description of Artificial Sequence: Synthetic polypeptide
  VH of XENP020367
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSS

SEQ ID NO: 7246 - protein, 108 aa, Artificial Sequence; identical to SEQ ID NO: 6193
  Description of Artificial Sequence: Synthetic polypeptide
  VL of XENP020367

SEQ ID NO: 7247 - protein, 5 aa, Artificial Sequence
  Description of Artificial Sequence: Synthetic peptide
  XENP020367 vhCDR1
SYTMH

SEQ ID NO: 7248 - protein, 17 aa, Artificial Sequence
  Description of Artificial Sequence: Synthetic peptide
  XENP020367 vhCDR2
FISYDGNQKYYADSVKG

SEQ ID NO: 7249 - protein, 9 aa, Artificial Sequence
  Description of Artificial Sequence: Synthetic peptide
  XENP020367 vhCDR3
TSHLGPFDL

SEQ ID NO: 7250 - protein, 12 aa, Artificial Sequence
  Description of Artificial Sequence: Synthetic peptide
  XENP020367 vlCDR1
RASQSVGSSYLA

SEQ ID NO: 7251 - protein, 7 aa, Artificial Sequence
  Description of Artificial Sequence: Synthetic peptide
  XENP020367 vlCDR2
GAFSRAT

SEQ ID NO: 7252 - protein, 9 aa, Artificial Sequence
  Description of Artificial Sequence: Synthetic peptide
  XENP020367 vlCDR3
QQYGSSPWT

SEQ ID NO: 7253 - protein, 246 aa, Artificial Sequence
  Description of Artificial Sequence: Synthetic polypeptide
  XENP020368 [CTLA-4]_H3.17_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7254 - protein, 118 aa, Artificial Sequence
  Description of Artificial Sequence: Synthetic polypeptide
  VH of XENP020368
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSS

SEQ ID NO: 7255 - protein, 108 aa, Artificial Sequence; identical to SEQ ID NO: 6193
  Description of Artificial Sequence: Synthetic polypeptide
  VL of XENP020368

SEQ ID NO: 7256 - protein, 5 aa, Artificial Sequence
  Description of Artificial Sequence: Synthetic peptide
  XENP020368 vhCDR1
SYTMH

SEQ ID NO: 7257 - protein, 17 aa, Artificial Sequence
  Description of Artificial Sequence: Synthetic peptide
  XENP020368 vhCDR2
FISYDGNQKYYADSVKG

SEQ ID NO: 7258 - protein, 9 aa, Artificial Sequence
  Description of Artificial Sequence: Synthetic peptide
  XENP020368 vhCDR3
GGLLGPFDL

SEQ ID NO: 7259 - protein, 12 aa, Artificial Sequence
  Description of Artificial Sequence: Synthetic peptide
  XENP020368 vlCDR1
RASQSVGSSYLA

SEQ ID NO: 7260 - protein, 7 aa, Artificial Sequence
  Description of Artificial Sequence: Synthetic peptide
  XENP020368 vlCDR2
GAFSRAT

SEQ ID NO: 7261 - protein, 9 aa, Artificial Sequence
  Description of Artificial Sequence: Synthetic peptide
  XENP020368 vlCDR3
QQYGSSPWT

SEQ ID NO: 7262 - protein, 246 aa, Artificial Sequence
  Description of Artificial Sequence: Synthetic polypeptide
  XENP020369 [CTLA-4]_H3.18_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7263 - protein, 118 aa, Artificial Sequence
  Description of Artificial Sequence: Synthetic polypeptide
  VH of XENP020369
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSS

SEQ ID NO: 7264 - protein, 108 aa, Artificial Sequence; identical to SEQ ID NO: 6193
  Description of Artificial Sequence: Synthetic polypeptide
  VL of XENP020369

SEQ ID NO: 7265 - protein, 5 aa, Artificial Sequence
  Description of Artificial Sequence: Synthetic peptide
  XENP020369 vhCDR1
SYTMH

SEQ ID NO: 7266 - protein, 17 aa, Artificial Sequence
  Description of Artificial Sequence: Synthetic peptide
  XENP020369 vhCDR2
FISYDGNQKYYADSVKG

SEQ ID NO: 7267 - protein, 9 aa, Artificial Sequence
  Description of Artificial Sequence: Synthetic peptide
  XENP020369 vhCDR3
TSLLGPFDL

SEQ ID NO: 7268 - protein, 12 aa, Artificial Sequence
  Description of Artificial Sequence: Synthetic peptide
  XENP020369 vlCDR1
RASQSVGSSYLA

SEQ ID NO: 7269 - protein, 7 aa, Artificial Sequence
  Description of Artificial Sequence: Synthetic peptide
  XENP020369 vlCDR2
GAFSRAT

SEQ ID NO: 7270 - protein, 9 aa, Artificial Sequence
  Description of Artificial Sequence: Synthetic peptide
  XENP020369 vlCDR3
QQYGSSPWT

SEQ ID NO: 7271 - protein, 246 aa, Artificial Sequence
  Description of Artificial Sequence: Synthetic polypeptide
  XENP020370 [CTLA-4]_H3.19_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7272 - protein, 118 aa, Artificial Sequence
  Description of Artificial Sequence: Synthetic polypeptide
  VH of XENP020370
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSS

SEQ ID NO: 7273 - protein, 108 aa, Artificial Sequence; identical to SEQ ID NO: 6193
  Description of Artificial Sequence: Synthetic polypeptide
  VL of XENP020370

SEQ ID NO: 7274 - protein, 5 aa, Artificial Sequence
  Description of Artificial Sequence: Synthetic peptide
  XENP020370 vhCDR1
SYTMH

SEQ ID NO: 7275 - protein, 17 aa, Artificial Sequence
  Description of Artificial Sequence: Synthetic peptide
  XENP020370 vhCDR2
FISYDGNTKYYADSVKG

SEQ ID NO: 7276 - protein, 9 aa, Artificial Sequence
  Description of Artificial Sequence: Synthetic peptide
  XENP020370 vhCDR3
GGHLGPFDL

SEQ ID NO: 7277 - protein, 12 aa, Artificial Sequence
  Description of Artificial Sequence: Synthetic peptide
  XENP020370 vlCDR1
RASQSVGSSYLA

SEQ ID NO: 7278 - protein, 7 aa, Artificial Sequence
  Description of Artificial Sequence: Synthetic peptide
  XENP020370 vlCDR2
GAFSRAT

SEQ ID NO: 7279 - protein, 9 aa, Artificial Sequence
  Description of Artificial Sequence: Synthetic peptide
  XENP020370 vlCDR3
QQYGSSPWT

SEQ ID NO: 7280 - protein, 246 aa, Artificial Sequence
  Description of Artificial Sequence: Synthetic polypeptide
  XENP020371 [CTLA-4]_H3.20_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7281 - protein, 118 aa, Artificial Sequence
  Description of Artificial Sequence: Synthetic polypeptide
  VH of XENP020371
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSS

SEQ ID NO: 7282 - protein, 108 aa, Artificial Sequence; identical to SEQ ID NO: 6193
  Description of Artificial Sequence: Synthetic polypeptide
  VL of XENP020371

SEQ ID NO: 7283 - protein, 5 aa, Artificial Sequence
  Description of Artificial Sequence: Synthetic peptide
  XENP020371 vhCDR1
SYTMH

SEQ ID NO: 7284 - protein, 17 aa, Artificial Sequence
  Description of Artificial Sequence: Synthetic peptide
  XENP020371 vhCDR2
FISYDGNTKYYADSVKG

SEQ ID NO: 7285 - protein, 9 aa, Artificial Sequence
  Description of Artificial Sequence: Synthetic peptide
  XENP020371 vhCDR3
TSHLGPFDL

SEQ ID NO: 7286 - protein, 12 aa, Artificial Sequence
  Description of Artificial Sequence: Synthetic peptide
  XENP020371 vlCDR1
RASQSVGSSYLA

SEQ ID NO: 7287 - protein, 7 aa, Artificial Sequence
  Description of Artificial Sequence: Synthetic peptide
  XENP020371 vlCDR2
GAFSRAT

SEQ ID NO: 7288 - protein, 9 aa, Artificial Sequence
  Description of Artificial Sequence: Synthetic peptide
  XENP020371 vlCDR3
QQYGSSPWT

SEQ ID NO: 7289 - protein, 246 aa, Artificial Sequence
  Description of Artificial Sequence: Synthetic polypeptide
  XENP020372 [CTLA-4]_H3.21_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7290 - protein, 118 aa, Artificial Sequence
  Description of Artificial Sequence: Synthetic polypeptide
  VH of XENP020372
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSS

SEQ ID NO: 7291 - protein, 108 aa, Artificial Sequence; identical to SEQ ID NO: 6193
  Description of Artificial Sequence: Synthetic polypeptide
  VL of XENP020372

SEQ ID NO: 7292 - protein, 5 aa, Artificial Sequence
  Description of Artificial Sequence: Synthetic peptide
  XENP020372 vhCDR1
SYTMH

SEQ ID NO: 7293 - protein, 17 aa, Artificial Sequence
  Description of Artificial Sequence: Synthetic peptide
  XENP020372 vhCDR2
FISYDGNTKYYADSVKG

SEQ ID NO: 7294 - protein, 9 aa, Artificial Sequence
  Description of Artificial Sequence: Synthetic peptide
  XENP020372 vhCDR3
GGLLGPFDL

SEQ ID NO: 7295 - protein, 12 aa, Artificial Sequence
  Description of Artificial Sequence: Synthetic peptide
  XENP020372 vlCDR1
RASQSVGSSYLA

SEQ ID NO: 7296 - protein, 7 aa, Artificial Sequence
  Description of Artificial Sequence: Synthetic peptide
  XENP020372 vlCDR2
GAFSRAT

SEQ ID NO: 7297 - protein, 9 aa, Artificial Sequence
  Description of Artificial Sequence: Synthetic peptide
  XENP020372 vlCDR3
QQYGSSPWT

SEQ ID NO: 7298 - protein, 246 aa, Artificial Sequence
  Description of Artificial Sequence: Synthetic polypeptide
  XENP020373 [CTLA-4]_H3.22_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7299 - protein, 118 aa, Artificial Sequence
  Description of Artificial Sequence: Synthetic polypeptide
  VH of XENP020373
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSS

SEQ ID NO: 7300 - protein, 108 aa, Artificial Sequence; identical to SEQ ID NO: 6193
  Description of Artificial Sequence: Synthetic polypeptide
  VL of XENP020373

SEQ ID NO: 7301 - protein, 5 aa, Artificial Sequence
  Description of Artificial Sequence: Synthetic peptide
  XENP020373 vhCDR1
SYTMH

SEQ ID NO: 7302 - protein, 17 aa, Artificial Sequence
  Description of Artificial Sequence: Synthetic peptide
  XENP020373 vhCDR2
FISYDGNTKYYADSVKG

SEQ ID NO: 7303 - protein, 9 aa, Artificial Sequence
  Description of Artificial Sequence: Synthetic peptide
  XENP020373 vhCDR3
TSLLGPFDL

SEQ ID NO: 7304 - protein, 12 aa, Artificial Sequence
  Description of Artificial Sequence: Synthetic peptide
  XENP020373 vlCDR1
RASQSVGSSYLA

SEQ ID NO: 7305 - protein, 7 aa, Artificial Sequence
  Description of Artificial Sequence: Synthetic peptide
  XENP020373 vlCDR2
GAFSRAT

SEQ ID NO: 7306 - protein, 9 aa, Artificial Sequence
  Description of Artificial Sequence: Synthetic peptide
  XENP020373 vlCDR3
QQYGSSPWT

SEQ ID NO: 7307 - protein, 246 aa, Artificial Sequence
  Description of Artificial Sequence: Synthetic polypeptide
  XENP020374 [CTLA-4]_H3.23_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7308 - protein, 118 aa, Artificial Sequence; identical to SEQ ID NO: 2395
  Description of Artificial Sequence: Synthetic polypeptide
  VH of XENP020374

SEQ ID NO: 7309 - protein, 108 aa, Artificial Sequence; identical to SEQ ID NO: 6193
  Description of Artificial Sequence: Synthetic polypeptide
  VL of XENP020374

SEQ ID NO: 7310 - protein, 5 aa, Artificial Sequence
  Description of Artificial Sequence: Synthetic peptide
  XENP020374 vhCDR1
SYTMH

SEQ ID NO: 7311 - protein, 17 aa, Artificial Sequence
  Description of Artificial Sequence: Synthetic peptide
  XENP020374 vhCDR2
FISYDGNYKYYADSVKG

SEQ ID NO: 7312 - protein, 9 aa, Artificial Sequence
  Description of Artificial Sequence: Synthetic peptide
  XENP020374 vhCDR3
GGHLGPFDL

SEQ ID NO: 7313 - protein, 12 aa, Artificial Sequence
  Description of Artificial Sequence: Synthetic peptide
  XENP020374 vlCDR1
RASQSVGSSYLA

SEQ ID NO: 7314 - protein, 7 aa, Artificial Sequence
  Description of Artificial Sequence: Synthetic peptide
  XENP020374 vlCDR2
GAFSRAT

SEQ ID NO: 7315 - protein, 9 aa, Artificial Sequence
  Description of Artificial Sequence: Synthetic peptide
  XENP020374 vlCDR3
QQYGSSPWT

SEQ ID NO: 7316 - protein, 246 aa, Artificial Sequence
  Description of Artificial Sequence: Synthetic polypeptide
  XENP020375 [CTLA-4]_H3.24_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7317 - protein, 118 aa, Artificial Sequence
  Description of Artificial Sequence: Synthetic polypeptide
  VH of XENP020375
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSS

SEQ ID NO: 7318 - protein, 108 aa, Artificial Sequence; identical to SEQ ID NO: 6193
  Description of Artificial Sequence: Synthetic polypeptide
  VL of XENP020375

SEQ ID NO: 7319 - protein, 5 aa, Artificial Sequence
  Description of Artificial Sequence: Synthetic peptide
  XENP020375 vhCDR1
SYTMH

SEQ ID NO: 7320 - protein, 17 aa, Artificial Sequence
  Description of Artificial Sequence: Synthetic peptide
  XENP020375 vhCDR2
FISYDGNYKYYADSVKG

SEQ ID NO: 7321 - protein, 9 aa, Artificial Sequence
  Description of Artificial Sequence: Synthetic peptide
  XENP020375 vhCDR3
TSHLGPFDL

SEQ ID NO: 7322 - protein, 12 aa, Artificial Sequence
  Description of Artificial Sequence: Synthetic peptide
  XENP020375 vlCDR1
RASQSVGSSYLA

SEQ ID NO: 7323 - protein, 7 aa, Artificial Sequence
  Description of Artificial Sequence: Synthetic peptide
  XENP020375 vlCDR2
GAFSRAT

SEQ ID NO: 7324 - protein, 9 aa, Artificial Sequence
  Description of Artificial Sequence: Synthetic peptide
  XENP020375 vlCDR3
QQYGSSPWT

SEQ ID NO: 7325 - protein, 246 aa, Artificial Sequence
  Description of Artificial Sequence: Synthetic polypeptide
  XENP020376 [CTLA-4]_H3.25_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7326 - protein, 118 aa, Artificial Sequence
  Description of Artificial Sequence: Synthetic polypeptide
  VH of XENP020376
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSS

SEQ ID NO: 7327 - protein, 108 aa, Artificial Sequence; identical to SEQ ID NO: 6193
  Description of Artificial Sequence: Synthetic polypeptide
  VL of XENP020376

SEQ ID NO: 7328 - protein, 5 aa, Artificial Sequence
  Description of Artificial Sequence: Synthetic peptide
  XENP020376 vhCDR1
SYTMH

SEQ ID NO: 7329 - protein, 17 aa, Artificial Sequence
  Description of Artificial Sequence: Synthetic peptide
  XENP020376 vhCDR2
FISYDGNYKYYADSVKG

SEQ ID NO: 7330 - protein, 9 aa, Artificial Sequence
  Description of Artificial Sequence: Synthetic peptide
  XENP020376 vhCDR3
GGLLGPFDL

SEQ ID NO: 7331 - protein, 12 aa, Artificial Sequence
  Description of Artificial Sequence: Synthetic peptide
  XENP020376 vlCDR1
RASQSVGSSYLA

SEQ ID NO: 7332 - protein, 7 aa, Artificial Sequence
  Description of Artificial Sequence: Synthetic peptide
  XENP020376 vlCDR2
GAFSRAT

SEQ ID NO: 7333 - protein, 9 aa, Artificial Sequence
  Description of Artificial Sequence: Synthetic peptide
  XENP020376 vlCDR3
QQYGSSPWT

SEQ ID NO: 7334 - protein, 246 aa, Artificial Sequence
  Description of Artificial Sequence: Synthetic polypeptide
  XENP020377 [CTLA-4]_H3.26_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7335 - protein, 118 aa, Artificial Sequence
  Description of Artificial Sequence: Synthetic polypeptide
  VH of XENP020377
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSS

SEQ ID NO: 7336 - protein, 108 aa, Artificial Sequence; identical to SEQ ID NO: 6193
  Description of Artificial Sequence: Synthetic polypeptide
  VL of XENP020377

SEQ ID NO: 7337 - protein, 5 aa, Artificial Sequence
  Description of Artificial Sequence: Synthetic peptide
  XENP020377 vhCDR1
SYTMH

SEQ ID NO: 7338 - protein, 17 aa, Artificial Sequence
  Description of Artificial Sequence: Synthetic peptide
  XENP020377 vhCDR2
FISYDGNYKYYADSVKG

SEQ ID NO: 7339 - protein, 9 aa, Artificial Sequence
  Description of Artificial Sequence: Synthetic peptide
  XENP020377 vhCDR3
TSLLGPFDL

SEQ ID NO: 7340 - protein, 12 aa, Artificial Sequence
  Description of Artificial Sequence: Synthetic peptide
  XENP020377 vlCDR1
RASQSVGSSYLA

SEQ ID NO: 7341 - protein, 7 aa, Artificial Sequence
  Description of Artificial Sequence: Synthetic peptide
  XENP020377 vlCDR2
GAFSRAT

SEQ ID NO: 7342 - protein, 9 aa, Artificial Sequence
  Description of Artificial Sequence: Synthetic peptide
  XENP020377 vlCDR3
QQYGSSPWT

SEQ ID NO: 7343 - protein, 246 aa, Artificial Sequence
  Description of Artificial Sequence: Synthetic polypeptide
  XENP020378 [CTLA-4]_H3.4_L0.118_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7344 - protein, 118 aa, Artificial Sequence; identical to SEQ ID NO: 7137
  Description of Artificial Sequence: Synthetic polypeptide
  VH of XENP020378

SEQ ID NO: 7345 - protein, 108 aa, Artificial Sequence
  Description of Artificial Sequence: Synthetic polypeptide
  VL of XENP020378
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7346 - protein, 5 aa, Artificial Sequence
  Description of Artificial Sequence: Synthetic peptide
  XENP020378 vhCDR1
SYTMH

SEQ ID NO: 7347 - protein, 17 aa, Artificial Sequence
  Description of Artificial Sequence: Synthetic peptide
  XENP020378 vhCDR2
FISYDGNHKYYADSVKG

SEQ ID NO: 7348 - protein, 9 aa, Artificial Sequence
  Description of Artificial Sequence: Synthetic peptide
  XENP020378 vhCDR3
TGHLGPFDL

SEQ ID NO: 7349 - protein, 12 aa, Artificial Sequence
  Description of Artificial Sequence: Synthetic peptide
  XENP020378 vlCDR1
RASQSVGSSYLA

SEQ ID NO: 7350 - protein, 7 aa, Artificial Sequence
  Description of Artificial Sequence: Synthetic peptide
  XENP020378 vlCDR2
GAFSRAT

SEQ ID NO: 7351 - protein, 9 aa, Artificial Sequence
  Description of Artificial Sequence: Synthetic peptide
  XENP020378 vlCDR3
QQYGSSPWT

SEQ ID NO: 7352 - protein, 246 aa, Artificial Sequence
  Description of Artificial Sequence: Synthetic polypeptide
  XENP020379 [CTLA-4]_H3.4_L0.119_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7353 - protein, 118 aa, Artificial Sequence; identical to SEQ ID NO: 7137
  Description of Artificial Sequence: Synthetic polypeptide
  VH of XENP020379

SEQ ID NO: 7354 - protein, 108 aa, Artificial Sequence; identical to SEQ ID NO: 3741
  Description of Artificial Sequence: Synthetic polypeptide
  VL of XENP020379

SEQ ID NO: 7355 - protein, 5 aa, Artificial Sequence
  Description of Artificial Sequence: Synthetic peptide
  XENP020379 vhCDR1
SYTMH

SEQ ID NO: 7356 - protein, 17 aa, Artificial Sequence
  Description of Artificial Sequence: Synthetic peptide
  XENP020379 vhCDR2
FISYDGNHKYYADSVKG

SEQ ID NO: 7357 - protein, 9 aa, Artificial Sequence
  Description of Artificial Sequence: Synthetic peptide
  XENP020379 vhCDR3
TGHLGPFDL

SEQ ID NO: 7358 - protein, 12 aa, Artificial Sequence
  Description of Artificial Sequence: Synthetic peptide
  XENP020379 vlCDR1
RASQSVGSSYLA

SEQ ID NO: 7359 - protein, 7 aa, Artificial Sequence
  Description of Artificial Sequence: Synthetic peptide
  XENP020379 vlCDR2
GAFSRAT

SEQ ID NO: 7360 - protein, 9 aa, Artificial Sequence
  Description of Artificial Sequence: Synthetic peptide
  XENP020379 vlCDR3
QQYGSSPWT

SEQ ID NO: 7361 - protein, 246 aa, Artificial Sequence
  Description of Artificial Sequence: Synthetic polypeptide
  XENP020380 [CTLA-4]_H3.4_L0.120_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7362 - protein, 118 aa, Artificial Sequence; identical to SEQ ID NO: 7137
  Description of Artificial Sequence: Synthetic polypeptide
  VH of XENP020380

SEQ ID NO: 7363 - protein, 108 aa, Artificial Sequence
  Description of Artificial Sequence: Synthetic polypeptide
  VL of XENP020380
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7364 - protein, 5 aa, Artificial Sequence
  Description of Artificial Sequence: Synthetic peptide
  XENP020380 vhCDR1
SYTMH

SEQ ID NO: 7365 - protein, 17 aa, Artificial Sequence
  Description of Artificial Sequence: Synthetic peptide
  XENP020380 vhCDR2
FISYDGNHKYYADSVKG

SEQ ID NO: 7366 - protein, 9 aa, Artificial Sequence
  Description of Artificial Sequence: Synthetic peptide
  XENP020380 vhCDR3
TGHLGPFDL

SEQ ID NO: 7367 - protein, 12 aa, Artificial Sequence
  Description of Artificial Sequence: Synthetic peptide
  XENP020380 vlCDR1
RASQSVSSSYLA

SEQ ID NO: 7368 - protein, 7 aa, Artificial Sequence
  Description of Artificial Sequence: Synthetic peptide
  XENP020380 vlCDR2
GAFSRAT

SEQ ID NO: 7369 - protein, 9 aa, Artificial Sequence
  Description of Artificial Sequence: Synthetic peptide
  XENP020380 vlCDR3
QQYGSSPWT

SEQ ID NO: 7370 - protein, 246 aa, Artificial Sequence
  Description of Artificial Sequence: Synthetic polypeptide
  XENP020381 [CTLA-4]_H3.4_L0.121_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7371 - protein, 118 aa, Artificial Sequence; identical to SEQ ID NO: 7137
  Description of Artificial Sequence: Synthetic polypeptide
  VH of XENP020381

SEQ ID NO: 7372 - protein, 108 aa, Artificial Sequence
  Description of Artificial Sequence: Synthetic polypeptide
  VL of XENP020381
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7373 - protein, 5 aa, Artificial Sequence
  Description of Artificial Sequence: Synthetic peptide
  XENP020381 vhCDR1
SYTMH

SEQ ID NO: 7374 - protein, 17 aa, Artificial Sequence
  Description of Artificial Sequence: Synthetic peptide
  XENP020381 vhCDR2
FISYDGNHKYYADSVKG

SEQ ID NO: 7375 - protein, 9 aa, Artificial Sequence
  Description of Artificial Sequence: Synthetic peptide
  XENP020381 vhCDR3
TGHLGPFDL

SEQ ID NO: 7376 - protein, 12 aa, Artificial Sequence
  Description of Artificial Sequence: Synthetic peptide
  XENP020381 vlCDR1
RASQSVGSSYLA

SEQ ID NO: 7377 - protein, 7 aa, Artificial Sequence
  Description of Artificial Sequence: Synthetic peptide
  XENP020381 vlCDR2
GASSRAT

SEQ ID NO: 7378 - protein, 9 aa, Artificial Sequence
  Description of Artificial Sequence: Synthetic peptide
  XENP020381 vlCDR3
QQYGSSPWT

SEQ ID NO: 7379 - protein, 246 aa, Artificial Sequence
  Description of Artificial Sequence: Synthetic polypeptide
  XENP020382 [CTLA-4]_H3.4_L0.122_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 7380 - protein, 118 aa, Artificial Sequence; identical to SEQ ID NO: 7137
  Description of Artificial Sequence: Synthetic polypeptide
  VH of XENP020382

SEQ ID NO: 7381 - protein, 108 aa, Artificial Sequence; identical to SEQ ID NO: 6157
  Description of Artificial Sequence: Synthetic polypeptide
  VL of XENP020382

SEQ ID NO: 7382 - protein, 5 aa, Artificial Sequence
  Description of Artificial Sequence: Synthetic peptide
  XENP020382 vhCDR1
SYTMH

SEQ ID NO: 7383 - protein, 17 aa, Artificial Sequence
  Description of Artificial Sequence: Synthetic peptide
  XENP020382 vhCDR2
FISYDGNHKYYADSVKG

SEQ ID NO: 7384 - protein, 9 aa, Artificial Sequence
  Description of Artificial Sequence: Synthetic peptide
  XENP020382 vhCDR3
TGHLGPFDL

SEQ ID NO: 7385 - protein, 12 aa, Artificial Sequence
  Description of Artificial Sequence: Synthetic peptide
  XENP020382 vlCDR1
RASQSVGSSYLA

SEQ ID NO: 7386 - protein, 7 aa, Artificial Sequence
  Description of Artificial Sequence: Synthetic peptide
  XENP020382 vlCDR2
GAFSRAT

SEQ ID NO: 7387 - protein, 9 aa, Artificial Sequence
  Description of Artificial Sequence: Synthetic peptide
  XENP020382 vlCDR3
QQYGSSPWT

SEQ ID NO: 7388 - protein, 246 aa, Artificial Sequence
  Description of Artificial Sequence: Synthetic polypeptide
  XENP020383 [CTLA-4]_H3.4_L0.123_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7389 - protein, 118 aa, Artificial Sequence; identical to SEQ ID NO: 7137
  Description of Artificial Sequence: Synthetic polypeptide
  VH of XENP020383

SEQ ID NO: 7390 - protein, 108 aa, Artificial Sequence
  Description of Artificial Sequence: Synthetic polypeptide
  VL of XENP020383
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7391 - protein, 5 aa, Artificial Sequence
  Description of Artificial Sequence: Synthetic peptide
  XENP020383 vhCDR1
SYTMH

SEQ ID NO: 7392 - protein, 17 aa, Artificial Sequence
  Description of Artificial Sequence: Synthetic peptide
  XENP020383 vhCDR2
FISYDGNHKYYADSVKG

SEQ ID NO: 7393 - protein, 9 aa, Artificial Sequence
  Description of Artificial Sequence: Synthetic peptide
  XENP020383 vhCDR3
TGHLGPFDL

SEQ ID NO: 7394 - protein, 12 aa, Artificial Sequence
  Description of Artificial Sequence: Synthetic peptide
  XENP020383 vlCDR1
RASQSVSSSYLA

SEQ ID NO: 7395 - protein, 7 aa, Artificial Sequence
  Description of Artificial Sequence: Synthetic peptide
  XENP020383 vlCDR2
GAFSRAT

SEQ ID NO: 7396 - protein, 9 aa, Artificial Sequence
  Description of Artificial Sequence: Synthetic peptide
  XENP020383 vlCDR3
QQYGSSPWT

SEQ ID NO: 7397 - protein, 246 aa, Artificial Sequence
  Description of Artificial Sequence: Synthetic polypeptide
  XENP020384 [CTLA-4]_H3.4_L0.124_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7398 - protein, 118 aa, Artificial Sequence; identical to SEQ ID NO: 7137
  Description of Artificial Sequence: Synthetic polypeptide
  VH of XENP020384

SEQ ID NO: 7399 - protein, 108 aa, Artificial Sequence
  Description of Artificial Sequence: Synthetic polypeptide
  VL of XENP020384
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7400 - protein, 5 aa, Artificial Sequence
  Description of Artificial Sequence: Synthetic peptide
  XENP020384 vhCDR1
SYTMH

SEQ ID NO: 7401 - protein, 17 aa, Artificial Sequence
  Description of Artificial Sequence: Synthetic peptide
  XENP020384 vhCDR2
FISYDGNHKYYADSVKG

SEQ ID NO: 7402 - protein, 9 aa, Artificial Sequence
  Description of Artificial Sequence: Synthetic peptide
  XENP020384 vhCDR3
TGHLGPFDL

SEQ ID NO: 7403 - protein, 12 aa, Artificial Sequence
  Description of Artificial Sequence: Synthetic peptide
  XENP020384 vlCDR1
RASQSVGSSYLA

SEQ ID NO: 7404 - protein, 7 aa, Artificial Sequence
  Description of Artificial Sequence: Synthetic peptide
  XENP020384 vlCDR2
GASSRAT

SEQ ID NO: 7405 - protein, 9 aa, Artificial Sequence
  Description of Artificial Sequence: Synthetic peptide
  XENP020384 vlCDR3
QQYGSSPWT

SEQ ID NO: 7406 - protein, 246 aa, Artificial Sequence
  Description of Artificial Sequence: Synthetic polypeptide
  XENP020385 [CTLA-4]_H3.4_L0.125_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7407 - protein, 118 aa, Artificial Sequence; identical to SEQ ID NO: 7137
  Description of Artificial Sequence: Synthetic polypeptide
  VH of XENP020385

SEQ ID NO: 7408 - protein, 108 aa, Artificial Sequence; identical to SEQ ID NO: 2411
  Description of Artificial Sequence: Synthetic polypeptide
  VL of XENP020385

SEQ ID NO: 7409 - protein, 5 aa, Artificial Sequence
  Description of Artificial Sequence: Synthetic peptide
  XENP020385 vhCDR1
SYTMH

SEQ ID NO: 7410 - protein, 17 aa, Artificial Sequence
  Description of Artificial Sequence: Synthetic peptide
  XENP020385 vhCDR2
FISYDGNHKYYADSVKG

SEQ ID NO: 7411 - protein, 9 aa, Artificial Sequence
  Description of Artificial Sequence: Synthetic peptide
  XENP020385 vhCDR3
TGHLGPFDL

SEQ ID NO: 7412 - protein, 12 aa, Artificial Sequence
  Description of Artificial Sequence: Synthetic peptide
  XENP020385 vlCDR1
RASQSVSSSYLA

SEQ ID NO: 7413 - protein, 7 aa, Artificial Sequence
  Description of Artificial Sequence: Synthetic peptide
  XENP020385 vlCDR2
GAFSRAT

SEQ ID NO: 7414 - protein, 9 aa, Artificial Sequence
  Description of Artificial Sequence: Synthetic peptide
  XENP020385 vlCDR3
QQYGSSPWT

SEQ ID NO: 7415 - protein, 246 aa, Artificial Sequence
  Description of Artificial Sequence: Synthetic polypeptide
  XENP020386 [CTLA-4]_H3.4_L0.126_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7416 - protein, 118 aa, Artificial Sequence; identical to SEQ ID NO: 7137
  Description of Artificial Sequence: Synthetic polypeptide
  VH of XENP020386

SEQ ID NO: 7417 - protein, 108 aa, Artificial Sequence; identical to SEQ ID NO: 6742
  Description of Artificial Sequence: Synthetic polypeptide
  VL of XENP020386

SEQ ID NO: 7418 - protein, 5 aa, Artificial Sequence
  Description of Artificial Sequence: Synthetic peptide
  XENP020386 vhCDR1
SYTMH

SEQ ID NO: 7419 - protein, 17 aa, Artificial Sequence
  Description of Artificial Sequence: Synthetic peptide
  XENP020386 vhCDR2
FISYDGNHKYYADSVKG

SEQ ID NO: 7420 - protein, 9 aa, Artificial Sequence
  Description of Artificial Sequence: Synthetic peptide
  XENP020386 vhCDR3
TGHLGPFDL

SEQ ID NO: 7421 - protein, 12 aa, Artificial Sequence
  Description of Artificial Sequence: Synthetic peptide
  XENP020386 vlCDR1
RASQSVGSSYLA

SEQ ID NO: 7422 - protein, 7 aa, Artificial Sequence
  Description of Artificial Sequence: Synthetic peptide
  XENP020386 vlCDR2
GASSRAT

SEQ ID NO: 7423 - protein, 9 aa, Artificial Sequence
  Description of Artificial Sequence: Synthetic peptide
  XENP020386 vlCDR3
QQYGSSPWT

SEQ ID NO: 7424 - protein, 246 aa, Artificial Sequence
  Description of Artificial Sequence: Synthetic polypeptide
  XENP020387 [CTLA-4]_H3.4_L0.127_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7425 - protein, 118 aa, Artificial Sequence; identical to SEQ ID NO: 7137
  Description of Artificial Sequence: Synthetic polypeptide
  VH of XENP020387

SEQ ID NO: 7426 - protein, 108 aa, Artificial Sequence
  Description of Artificial Sequence: Synthetic polypeptide
  VL of XENP020387
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7427 - protein, 5 aa, Artificial Sequence
  Description of Artificial Sequence: Synthetic peptide
  XENP020387 vhCDR1
SYTMH

SEQ ID NO: 7428 - protein, 17 aa, Artificial Sequence
  Description of Artificial Sequence: Synthetic peptide
  XENP020387 vhCDR2
FISYDGNHKYYADSVKG

SEQ ID NO: 7429 - protein, 9 aa, Artificial Sequence
  Description of Artificial Sequence: Synthetic peptide
  XENP020387 vhCDR3
TGHLGPFDL

SEQ ID NO: 7430 - protein, 12 aa, Artificial Sequence
  Description of Artificial Sequence: Synthetic peptide
  XENP020387 vlCDR1
RASQSVSSSYLA

SEQ ID NO: 7431 - protein, 7 aa, Artificial Sequence
  Description of Artificial Sequence: Synthetic peptide
  XENP020387 vlCDR2
GASSRAT

SEQ ID NO: 7432 - protein, 9 aa, Artificial Sequence
  Description of Artificial Sequence: Synthetic peptide
  XENP020387 vlCDR3
QQYGSSPWT

SEQ ID NO: 7433 - protein, 246 aa, Artificial Sequence
  Description of Artificial Sequence: Synthetic polypeptide
  XENP020388 [CTLA-4]_H3.4_L0.128_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7434 - protein, 118 aa, Artificial Sequence; identical to SEQ ID NO: 7137
  Description of Artificial Sequence: Synthetic polypeptide
  VH of XENP020388

SEQ ID NO: 7435 - protein, 108 aa, Artificial Sequence
  Description of Artificial Sequence: Synthetic polypeptide
  VL of XENP020388
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 7436 - protein, 5 aa, Artificial Sequence
  Description of Artificial Sequence: Synthetic peptide
  XENP020388 vhCDR1
SYTMH

SEQ ID NO: 7437 - protein, 17 aa, Artificial Sequence
  Description of Artificial Sequence: Synthetic peptide
  XENP020388 vhCDR2
FISYDGNHKYYADSVKG

SEQ ID NO: 7438 - protein, 9 aa, Artificial Sequence
  Description of Artificial Sequence: Synthetic peptide
  XENP020388 vhCDR3
TGHLGPFDL

SEQ ID NO: 7439 - protein, 12 aa, Artificial Sequence
  Description of Artificial Sequence: Synthetic peptide
  XENP020388 vlCDR1
RASQSVSSSYLA

SEQ ID NO: 7440 - protein, 7 aa, Artificial Sequence
  Description of Artificial Sequence: Synthetic peptide
  XENP020388 vlCDR2
GAFSRAT

SEQ ID NO: 7441 - protein, 9 aa, Artificial Sequence
  Description of Artificial Sequence: Synthetic peptide
  XENP020388 vlCDR3
QQYGSSPWT

SEQ ID NO: 7442 - protein, 246 aa, Artificial Sequence
  Description of Artificial Sequence: Synthetic polypeptide
  XENP020389 [CTLA-4]_H3.4_L0.129_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7443 - protein, 118 aa, Artificial Sequence; identical to SEQ ID NO: 7137
  Description of Artificial Sequence: Synthetic polypeptide
  VH of XENP020389

SEQ ID NO: 7444 - protein, 108 aa, Artificial Sequence; identical to SEQ ID NO: 2396
  Description of Artificial Sequence: Synthetic polypeptide
  VL of XENP020389

SEQ ID NO: 7445 - protein, 5 aa, Artificial Sequence
  Description of Artificial Sequence: Synthetic peptide
  XENP020389 vhCDR1
SYTMH

SEQ ID NO: 7446 - protein, 17 aa, Artificial Sequence
  Description of Artificial Sequence: Synthetic peptide
  XENP020389 vhCDR2
FISYDGNHKYYADSVKG

SEQ ID NO: 7447 - protein, 9 aa, Artificial Sequence
  Description of Artificial Sequence: Synthetic peptide
  XENP020389 vhCDR3
TGHLGPFDL

SEQ ID NO: 7448 - protein, 12 aa, Artificial Sequence
  Description of Artificial Sequence: Synthetic peptide
  XENP020389 vlCDR1
RASQSVGSSYLA

SEQ ID NO: 7449 - protein, 7 aa, Artificial Sequence
  Description of Artificial Sequence: Synthetic peptide
  XENP020389 vlCDR2
GASSRAT

SEQ ID NO: 7450 - protein, 9 aa, Artificial Sequence
  Description of Artificial Sequence: Synthetic peptide
  XENP020389 vlCDR3
QQYGSSPWT

SEQ ID NO: 7451 - protein, 246 aa, Artificial Sequence
  Description of Artificial Sequence: Synthetic polypeptide
  XENP020390 [CTLA-4]_H3.4_L0.130_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7452 - protein, 118 aa, Artificial Sequence; identical to SEQ ID NO: 7137
  Description of Artificial Sequence: Synthetic polypeptide
  VH of XENP020390

SEQ ID NO: 7453 - protein, 108 aa, Artificial Sequence
  Description of Artificial Sequence: Synthetic polypeptide
  VL of XENP020390
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7454 - protein, 5 aa, Artificial Sequence
  Description of Artificial Sequence: Synthetic peptide
  XENP020390 vhCDR1
SYTMH

SEQ ID NO: 7455 - protein, 17 aa, Artificial Sequence
  Description of Artificial Sequence: Synthetic peptide
  XENP020390 vhCDR2
FISYDGNHKYYADSVKG

SEQ ID NO: 7456 - protein, 9 aa, Artificial Sequence
  Description of Artificial Sequence: Synthetic peptide
  XENP020390 vhCDR3
TGHLGPFDL

SEQ ID NO: 7457 - protein, 12 aa, Artificial Sequence
  Description of Artificial Sequence: Synthetic peptide
  XENP020390 vlCDR1
RASQSVSSSYLA

SEQ ID NO: 7458 - protein, 7 aa, Artificial Sequence
  Description of Artificial Sequence: Synthetic peptide
  XENP020390 vlCDR2
GASSRAT

SEQ ID NO: 7459 - protein, 9 aa, Artificial Sequence
  Description of Artificial Sequence: Synthetic peptide
  XENP020390 vlCDR3
QQYGSSPWT

SEQ ID NO: 7460 - protein, 246 aa, Artificial Sequence
  Description of Artificial Sequence: Synthetic polypeptide
  XENP020391 [CTLA-4]_H3.4_L0.131_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7461 - protein, 118 aa, Artificial Sequence; identical to SEQ ID NO: 7137
  Description of Artificial Sequence: Synthetic polypeptide
  VH of XENP020391

SEQ ID NO: 7462 - protein, 108 aa, Artificial Sequence
  Description of Artificial Sequence: Synthetic polypeptide
  VL of XENP020391
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7463 - protein, 5 aa, Artificial Sequence
  Description of Artificial Sequence: Synthetic peptide
  XENP020391 vhCDR1
SYTMH

SEQ ID NO: 7464 - protein, 17 aa, Artificial Sequence
  Description of Artificial Sequence: Synthetic peptide
  XENP020391 vhCDR2
FISYDGNHKYYADSVKG

SEQ ID NO: 7465 - protein, 9 aa, Artificial Sequence
  Description of Artificial Sequence: Synthetic peptide
  XENP020391 vhCDR3
TGHLGPFDL

SEQ ID NO: 7466 - protein, 12 aa, Artificial Sequence
  Description of Artificial Sequence: Synthetic peptide
  XENP020391 vlCDR1
RASQSVSSSYLA

SEQ ID NO: 7467 - protein, 7 aa, Artificial Sequence
  Description of Artificial Sequence: Synthetic peptide
  XENP020391 vlCDR2
GASSRAT

SEQ ID NO: 7468 - protein, 9 aa, Artificial Sequence
  Description of Artificial Sequence: Synthetic peptide
  XENP020391 vlCDR3
QQYGSSPWT

SEQ ID NO: 7469 - protein, 246 aa, Artificial Sequence
  Description of Artificial Sequence: Synthetic polypeptide
  XENP020392 [CTLA-4]_H3.4_L0.132_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7470 - protein, 118 aa, Artificial Sequence; identical to SEQ ID NO: 7137
  Description of Artificial Sequence: Synthetic polypeptide
  VH of XENP020392

SEQ ID NO: 7471 - protein, 108 aa, Artificial Sequence
  Description of Artificial Sequence: Synthetic polypeptide
  VL of XENP020392
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7472 - protein, 5 aa, Artificial Sequence
  Description of Artificial Sequence: Synthetic peptide
  XENP020392 vhCDR1
SYTMH

SEQ ID NO: 7473 - protein, 17 aa, Artificial Sequence
  Description of Artificial Sequence: Synthetic peptide
  XENP020392 vhCDR2
FISYDGNHKYYADSVKG

SEQ ID NO: 7474 - protein, 9 aa, Artificial Sequence
  Description of Artificial Sequence: Synthetic peptide
  XENP020392 vhCDR3
TGHLGPFDL

SEQ ID NO: 7475 - protein, 12 aa, Artificial Sequence
  Description of Artificial Sequence: Synthetic peptide
  XENP020392 vlCDR1
RASQSVSSSYLA

SEQ ID NO: 7476 - protein, 7 aa, Artificial Sequence
  Description of Artificial Sequence: Synthetic peptide
  XENP020392 vlCDR2
GASSRAT

SEQ ID NO: 7477 - protein, 9 aa, Artificial Sequence
  Description of Artificial Sequence: Synthetic peptide
  XENP020392 vlCDR3
QQYGSSPWT

SEQ ID NO: 7478 - protein, 246 aa, Artificial Sequence
  Description of Artificial Sequence: Synthetic polypeptide
  XENP020393 [CTLA-4]_H3.5_L2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 7479 - protein, 118 aa, Artificial Sequence; identical to SEQ ID NO: 7146
  Description of Artificial Sequence: Synthetic polypeptide
  VH of XENP020393

SEQ ID NO: 7480 - protein, 108 aa, Artificial Sequence; identical to SEQ ID NO: 4843
  Description of Artificial Sequence: Synthetic polypeptide
  VL of XENP020393

SEQ ID NO: 7481 - protein, 5 aa, Artificial Sequence
  Description of Artificial Sequence: Synthetic peptide
  XENP020393 vhCDR1
SYTMH

SEQ ID NO: 7482 - protein, 17 aa, Artificial Sequence
  Description of Artificial Sequence: Synthetic peptide
  XENP020393 vhCDR2
FISYDGNTKYYADSVKG

SEQ ID NO: 7483 - protein, 9 aa, Artificial Sequence
  Description of Artificial Sequence: Synthetic peptide
  XENP020393 vhCDR3
TGHLGPFDL

SEQ ID NO: 7484 - protein, 12 aa, Artificial Sequence
  Description of Artificial Sequence: Synthetic peptide
  XENP020393 vlCDR1
RASQSVGSSYLA

SEQ ID NO: 7485 - protein, 7 aa, Artificial Sequence
  Description of Artificial Sequence: Synthetic peptide
  XENP020393 vlCDR2
GAFSRAT

SEQ ID NO: 7486 - protein, 9 aa, Artificial Sequence
  Description of Artificial Sequence: Synthetic peptide
  XENP020393 vlCDR3
QQYGSSPWT

SEQ ID NO: 7487 - protein, 246 aa, Artificial Sequence
  Description of Artificial Sequence: Synthetic polypeptide
  XENP020394 [CTLA-4]_H3.5_L2.1_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 7488 - protein, 118 aa, Artificial Sequence; identical to SEQ ID NO: 7146
  Description of Artificial Sequence: Synthetic polypeptide
  VH of XENP020394

SEQ ID NO: 7489 - protein, 108 aa, Artificial Sequence
  Description of Artificial Sequence: Synthetic polypeptide
  VL of XENP020394
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 7490 - protein, 5 aa, Artificial Sequence
  Description of Artificial Sequence: Synthetic peptide
  XENP020394 vhCDR1
SYTMH

SEQ ID NO: 7491 - protein, 17 aa, Artificial Sequence
  Description of Artificial Sequence: Synthetic peptide
  XENP020394 vhCDR2
FISYDGNTKYYADSVKG

SEQ ID NO: 7492 - protein, 9 aa, Artificial Sequence
  Description of Artificial Sequence: Synthetic peptide
  XENP020394 vhCDR3
TGHLGPFDL

SEQ ID NO: 7493 - protein, 12 aa, Artificial Sequence
  Description of Artificial Sequence: Synthetic peptide
  XENP020394 vlCDR1
RASQSVSSSYLA

SEQ ID NO: 7494 - protein, 7 aa, Artificial Sequence
  Description of Artificial Sequence: Synthetic peptide
  XENP020394 vlCDR2
GAFSRAT

SEQ ID NO: 7495 - protein, 9 aa, Artificial Sequence
  Description of Artificial Sequence: Synthetic peptide
  XENP020394 vlCDR3
QQYGSSPWT

SEQ ID NO: 7496 - protein, 246 aa, Artificial Sequence
  Description of Artificial Sequence: Synthetic polypeptide
  XENP020395 [CTLA-4]_H3.5_L2.2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 7497 - protein, 118 aa, Artificial Sequence; identical to SEQ ID NO: 7146
  Description of Artificial Sequence: Synthetic polypeptide
  VH of XENP020395

SEQ ID NO: 7498 - protein, 108 aa, Artificial Sequence
  Description of Artificial Sequence: Synthetic polypeptide
  VL of XENP020395
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 7499 - protein, 5 aa, Artificial Sequence
  Description of Artificial Sequence: Synthetic peptide
  XENP020395 vhCDR1
SYTMH

SEQ ID NO: 7500 - protein, 17 aa, Artificial Sequence
  Description of Artificial Sequence: Synthetic peptide
  XENP020395 vhCDR2
FISYDGNTKYYADSVKG

SEQ ID NO: 7501 - protein, 9 aa, Artificial Sequence
  Description of Artificial Sequence: Synthetic peptide
  XENP020395 vhCDR3
TGHLGPFDL

SEQ ID NO: 7502 - protein, 12 aa, Artificial Sequence
  Description of Artificial Sequence: Synthetic peptide
  XENP020395 vlCDR1
RASQSVGSSYLA

SEQ ID NO: 7503 - protein, 7 aa, Artificial Sequence
  Description of Artificial Sequence: Synthetic peptide
  XENP020395 vlCDR2
GASSRAT

SEQ ID NO: 7504 - protein, 9 aa, Artificial Sequence
  Description of Artificial Sequence: Synthetic peptide
  XENP020395 vlCDR3
QQYGSSPWT

SEQ ID NO: 7505 - protein, 246 aa, Artificial Sequence
  Description of Artificial Sequence: Synthetic polypeptide
  XENP020396 [CTLA-4]_H3.5_L2.3_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 7506 - protein, 118 aa, Artificial Sequence; identical to SEQ ID NO: 7146
  Description of Artificial Sequence: Synthetic polypeptide
  VH of XENP020396

SEQ ID NO: 7507 - protein, 108 aa, Artificial Sequence
  Description of Artificial Sequence: Synthetic polypeptide
  VL of XENP020396
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 7508 - protein, 5 aa, Artificial Sequence
  Description of Artificial Sequence: Synthetic peptide
  XENP020396 vhCDR1
SYTMH

SEQ ID NO: 7509 - protein, 17 aa, Artificial Sequence
  Description of Artificial Sequence: Synthetic peptide
  XENP020396 vhCDR2
FISYDGNTKYYADSVKG

SEQ ID NO: 7510 - protein, 9 aa, Artificial Sequence
  Description of Artificial Sequence: Synthetic peptide
  XENP020396 vhCDR3
TGHLGPFDL

SEQ ID NO: 7511 - protein, 12 aa, Artificial Sequence
  Description of Artificial Sequence: Synthetic peptide
  XENP020396 vlCDR1
RASQSVSSSYLA

SEQ ID NO: 7512 - protein, 7 aa, Artificial Sequence
  Description of Artificial Sequence: Synthetic peptide
  XENP020396 vlCDR2
GASSRAT

SEQ ID NO: 7513 - protein, 9 aa, Artificial Sequence
  Description of Artificial Sequence: Synthetic peptide
  XENP020396 vlCDR3
QQYGSSPWT

SEQ ID NO: 7514 - protein, 246 aa, Artificial Sequence
  Description of Artificial Sequence: Synthetic polypeptide
  XENP020431 [CTLA-4]_H3.21_L0.124_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7515 - protein, 118 aa, Artificial Sequence; identical to SEQ ID NO: 7290
  Description of Artificial Sequence: Synthetic polypeptide
  VH of XENP020431

SEQ ID NO: 7516 - protein, 108 aa, Artificial Sequence; identical to SEQ ID NO: 7399
  Description of Artificial Sequence: Synthetic polypeptide
  VL of XENP020431

SEQ ID NO: 7517 - protein, 5 aa, Artificial Sequence
  Description of Artificial Sequence: Synthetic peptide
  XENP020431 vhCDR1
SYTMH

SEQ ID NO: 7518 - protein, 17 aa, Artificial Sequence
  Description of Artificial Sequence: Synthetic peptide
  XENP020431 vhCDR2
FISYDGNTKYYADSVKG

SEQ ID NO: 7519 - protein, 9 aa, Artificial Sequence
  Description of Artificial Sequence: Synthetic peptide
  XENP020431 vhCDR3
GGLLGPFDL

SEQ ID NO: 7520 - protein, 12 aa, Artificial Sequence
  Description of Artificial Sequence: Synthetic peptide
  XENP020431 vlCDR1
RASQSVGSSYLA

SEQ ID NO: 7521 - protein, 7 aa, Artificial Sequence
  Description of Artificial Sequence: Synthetic peptide
  XENP020431 vlCDR2
GASSRAT

SEQ ID NO: 7522 - protein, 9 aa, Artificial Sequence
  Description of Artificial Sequence: Synthetic peptide
  XENP020431 vlCDR3
QQYGSSPWT

SEQ ID NO: 7523 - protein, 246 aa, Artificial Sequence
  Description of Artificial Sequence: Synthetic polypeptide
  XENP020432 [CTLA-4]_H3.21_L0.129_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7524 - protein, 118 aa, Artificial Sequence; identical to SEQ ID NO: 7290
  Description of Artificial Sequence: Synthetic polypeptide
  VH of XENP020432

SEQ ID NO: 7525 - protein, 108 aa, Artificial Sequence; identical to SEQ ID NO: 2396
  Description of Artificial Sequence: Synthetic polypeptide
  VL of XENP020432

SEQ ID NO: 7526 - protein, 5 aa, Artificial Sequence
  Description of Artificial Sequence: Synthetic peptide
  XENP020432 vhCDR1
SYTMH

SEQ ID NO: 7527 - protein, 17 aa, Artificial Sequence
  Description of Artificial Sequence: Synthetic peptide
  XENP020432 vhCDR2
FISYDGNTKYYADSVKG

SEQ ID NO: 7528 - protein, 9 aa, Artificial Sequence
  Description of Artificial Sequence: Synthetic peptide
  XENP020432 vhCDR3
GGLLGPFDL

SEQ ID NO: 7529 - protein, 12 aa, Artificial Sequence
  Description of Artificial Sequence: Synthetic peptide
  XENP020432 vlCDR1
RASQSVGSSYLA

SEQ ID NO: 7530 - protein, 7 aa, Artificial Sequence
  Description of Artificial Sequence: Synthetic peptide
  XENP020432 vlCDR2
GASSRAT

SEQ ID NO: 7531 - protein, 9 aa, Artificial Sequence
  Description of Artificial Sequence: Synthetic peptide
  XENP020432 vlCDR3
QQYGSSPWT

SEQ ID NO: 7532 - protein, 246 aa, Artificial Sequence
  Description of Artificial Sequence: Synthetic polypeptide
  XENP020433 [CTLA-4]_H3.21_L0.132_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7533 - protein, 118 aa, Artificial Sequence; identical to SEQ ID NO: 7290
  Description of Artificial Sequence: Synthetic polypeptide
  VH of XENP020433

SEQ ID NO: 7534 - protein, 108 aa, Artificial Sequence; identical to SEQ ID NO: 7471
  Description of Artificial Sequence: Synthetic polypeptide
  VL of XENP020433

SEQ ID NO: 7535 - protein, 5 aa, Artificial Sequence
  Description of Artificial Sequence: Synthetic peptide
  XENP020433 vhCDR1
SYTMH

SEQ ID NO: 7536 - protein, 17 aa, Artificial Sequence
  Description of Artificial Sequence: Synthetic peptide
  XENP020433 vhCDR2
FISYDGNTKYYADSVKG

SEQ ID NO: 7537 - protein, 9 aa, Artificial Sequence
  Description of Artificial Sequence: Synthetic peptide
  XENP020433 vhCDR3
GGLLGPFDL

SEQ ID NO: 7538 - protein, 12 aa, Artificial Sequence
  Description of Artificial Sequence: Synthetic peptide
  XENP020433 vlCDR1
RASQSVSSSYLA

SEQ ID NO: 7539 - protein, 7 aa, Artificial Sequence
  Description of Artificial Sequence: Synthetic peptide
  XENP020433 vlCDR2
GASSRAT

SEQ ID NO: 7540 - protein, 9 aa, Artificial Sequence
  Description of Artificial Sequence: Synthetic peptide
  XENP020433 vlCDR3
QQYGSSPWT

SEQ ID NO: 7541 - protein, 246 aa, Artificial Sequence
  Description of Artificial Sequence: Synthetic polypeptide
  XENP020434 [CTLA-4]_H3.23_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7542 - protein, 118 aa, Artificial Sequence; identical to SEQ ID NO: 2395
  Description of Artificial Sequence: Synthetic polypeptide
  VH of XENP020434

SEQ ID NO: 7543 - protein, 108 aa, Artificial Sequence; identical to SEQ ID NO: 7399
  Description of Artificial Sequence: Synthetic polypeptide
  VL of XENP020434

SEQ ID NO: 7544 - protein, 5 aa, Artificial Sequence
  Description of Artificial Sequence: Synthetic peptide
  XENP020434 vhCDR1
SYTMH

SEQ ID NO: 7545 - protein, 17 aa, Artificial Sequence
  Description of Artificial Sequence: Synthetic peptide
  XENP020434 vhCDR2
FISYDGNYKYYADSVKG

SEQ ID NO: 7546 - protein, 9 aa, Artificial Sequence
  Description of Artificial Sequence: Synthetic peptide
  XENP020434 vhCDR3
GGHLGPFDL

SEQ ID NO: 7547 - protein, 12 aa, Artificial Sequence
  Description of Artificial Sequence: Synthetic peptide
  XENP020434 vlCDR1
RASQSVGSSYLA

SEQ ID NO: 7548 - protein, 7 aa, Artificial Sequence
  Description of Artificial Sequence: Synthetic peptide
  XENP020434 vlCDR2
GASSRAT

SEQ ID NO: 7549 - protein, 9 aa, Artificial Sequence
  Description of Artificial Sequence: Synthetic peptide
  XENP020434 vlCDR3
QQYGSSPWT

SEQ ID NO: 7550 - protein, 246 aa, Artificial Sequence
  Description of Artificial Sequence: Synthetic polypeptide
  XENP020435 [CTLA-4]_H3.23_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7551 - protein, 118 aa, Artificial Sequence; identical to SEQ ID NO: 2395
  Description of Artificial Sequence: Synthetic polypeptide
  VH of XENP020435

SEQ ID NO: 7552 - protein, 108 aa, Artificial Sequence; identical to SEQ ID NO: 2396
  Description of Artificial Sequence: Synthetic polypeptide
  VL of XENP020435

SEQ ID NO: 7553 - protein, 5 aa, Artificial Sequence
  Description of Artificial Sequence: Synthetic peptide
  XENP020435 vhCDR1
SYTMH

SEQ ID NO: 7554 - protein, 17 aa, Artificial Sequence
  Description of Artificial Sequence: Synthetic peptide
  XENP020435 vhCDR2
FISYDGNYKYYADSVKG

SEQ ID NO: 7555 - protein, 9 aa, Artificial Sequence
  Description of Artificial Sequence: Synthetic peptide
  XENP020435 vhCDR3
GGHLGPFDL

SEQ ID NO: 7556 - protein, 12 aa, Artificial Sequence
  Description of Artificial Sequence: Synthetic peptide
  XENP020435 vlCDR1
RASQSVGSSYLA

SEQ ID NO: 7557 - protein, 7 aa, Artificial Sequence
  Description of Artificial Sequence: Synthetic peptide
  XENP020435 vlCDR2
GASSRAT

SEQ ID NO: 7558 - protein, 9 aa, Artificial Sequence
  Description of Artificial Sequence: Synthetic peptide
  XENP020435 vlCDR3
QQYGSSPWT

SEQ ID NO: 7559 - protein, 246 aa, Artificial Sequence
  Description of Artificial Sequence: Synthetic polypeptide
  XENP020436 [CTLA-4]_H3.23_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7560 - protein, 118 aa, Artificial Sequence; identical to SEQ ID NO: 2395
  Description of Artificial Sequence: Synthetic polypeptide
  VH of XENP020436

SEQ ID NO: 7561 - protein, 108 aa, Artificial Sequence; identical to SEQ ID NO: 7471
  Description of Artificial Sequence: Synthetic polypeptide
  VL of XENP020436

SEQ ID NO: 7562 - protein, 5 aa, Artificial Sequence
  Description of Artificial Sequence: Synthetic peptide
  XENP020436 vhCDR1
SYTMH

SEQ ID NO: 7563 - protein, 17 aa, Artificial Sequence
  Description of Artificial Sequence: Synthetic peptide
  XENP020436 vhCDR2
FISYDGNYKYYADSVKG

SEQ ID NO: 7564 - protein, 9 aa, Artificial Sequence
  Description of Artificial Sequence: Synthetic peptide
  XENP020436 vhCDR3
GGHLGPFDL

SEQ ID NO: 7565 - protein, 12 aa, Artificial Sequence
  Description of Artificial Sequence: Synthetic peptide
  XENP020436 vlCDR1
RASQSVSSSYLA

SEQ ID NO: 7566 - protein, 7 aa, Artificial Sequence
  Description of Artificial Sequence: Synthetic peptide
  XENP020436 vlCDR2
GASSRAT

SEQ ID NO: 7567 - protein, 9 aa, Artificial Sequence
  Description of Artificial Sequence: Synthetic peptide
  XENP020436 vlCDR3
QQYGSSPWT

SEQ ID NO: 7568 - protein, 246 aa, Artificial Sequence
  Description of Artificial Sequence: Synthetic polypeptide
  XENP020437 [CTLA-4]_H3.25_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7569 - protein, 118 aa, Artificial Sequence; identical to SEQ ID NO: 7326
  Description of Artificial Sequence: Synthetic polypeptide
  VH of XENP020437

SEQ ID NO: 7570 - protein, 108 aa, Artificial Sequence; identical to SEQ ID NO: 7399
  Description of Artificial Sequence: Synthetic polypeptide
  VL of XENP020437

SEQ ID NO: 7571 - protein, 5 aa, Artificial Sequence
  Description of Artificial Sequence: Synthetic peptide
  XENP020437 vhCDR1
SYTMH

SEQ ID NO: 7572 - protein, 17 aa, Artificial Sequence
  Description of Artificial Sequence: Synthetic peptide
  XENP020437 vhCDR2
FISYDGNYKYYADSVKG

SEQ ID NO: 7573 - protein, 9 aa, Artificial Sequence
  Description of Artificial Sequence: Synthetic peptide
  XENP020437 vhCDR3
GGLLGPFDL

SEQ ID NO: 7574 - protein, 12 aa, Artificial Sequence
  Description of Artificial Sequence: Synthetic peptide
  XENP020437 vlCDR1
RASQSVGSSYLA

SEQ ID NO: 7575 - protein, 7 aa, Artificial Sequence
  Description of Artificial Sequence: Synthetic peptide
  XENP020437 vlCDR2
GASSRAT

SEQ ID NO: 7576 - protein, 9 aa, Artificial Sequence
  Description of Artificial Sequence: Synthetic peptide
  XENP020437 vlCDR3
QQYGSSPWT

SEQ ID NO: 7577 - protein, 246 aa, Artificial Sequence
  Description of Artificial Sequence: Synthetic polypeptide
  XENP020438 [CTLA-4]_H3.25_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 7578 - protein, 118 aa, Artificial Sequence; identical to SEQ ID NO: 7326
  Description of Artificial Sequence: Synthetic polypeptide
  VH of XENP020438

SEQ ID NO: 7579 - protein, 108 aa, Artificial Sequence; identical to SEQ ID NO: 2396
  Description of Artificial Sequence: Synthetic polypeptide
  VL of XENP020438

SEQ ID NO: 7580 - protein, 5 aa, Artificial Sequence
  Description of Artificial Sequence: Synthetic peptide
  XENP020438 vhCDR1
SYTMH

SEQ ID NO: 7581 - protein, 17 aa, Artificial Sequence
  Description of Artificial Sequence: Synthetic peptide
  XENP020438 vhCDR2
FISYDGNYKYYADSVKG

SEQ ID NO: 7582 - protein, 9 aa, Artificial Sequence
  Description of Artificial Sequence: Synthetic peptide
  XENP020438 vhCDR3
GGLLGPFDL

SEQ ID NO: 7583 - protein, 12 aa, Artificial Sequence
  Description of Artificial Sequence: Synthetic peptide
  XENP020438 vlCDR1
RASQSVGSSYLA

SEQ ID NO: 7584 - protein, 7 aa, Artificial Sequence
  Description of Artificial Sequence: Synthetic peptide
  XENP020438 vlCDR2
GASSRAT

SEQ ID NO: 7585 - protein, 9 aa, Artificial Sequence
  Description of Artificial Sequence: Synthetic peptide
  XENP020438 vlCDR3
QQYGSSPWT

SEQ ID NO: 7586 - protein, 246 aa, Artificial Sequence
  Description of Artificial Sequence: Synthetic polypeptide
  XENP020439 [CTLA-4]_H3.25_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7587 - protein, 118 aa, Artificial Sequence; identical to SEQ ID NO: 7326
  Description of Artificial Sequence: Synthetic polypeptide
  VH of XENP020439

SEQ ID NO: 7588 - protein, 108 aa, Artificial Sequence; identical to SEQ ID NO: 7471
  Description of Artificial Sequence: Synthetic polypeptide
  VL of XENP020439

SEQ ID NO: 7589 - protein, 5 aa, Artificial Sequence
  Description of Artificial Sequence: Synthetic peptide
  XENP020439 vhCDR1
SYTMH

SEQ ID NO: 7590 - protein, 17 aa, Artificial Sequence
  Description of Artificial Sequence: Synthetic peptide
  XENP020439 vhCDR2
FISYDGNYKYYADSVKG

SEQ ID NO: 7591 - protein, 9 aa, Artificial Sequence
  Description of Artificial Sequence: Synthetic peptide
  XENP020439 vhCDR3
GGLLGPFDL

SEQ ID NO: 7592 - protein, 12 aa, Artificial Sequence
  Description of Artificial Sequence: Synthetic peptide
  XENP020439 vlCDR1
RASQSVSSSYLA

SEQ ID NO: 7593 - protein, 7 aa, Artificial Sequence
  Description of Artificial Sequence: Synthetic peptide
  XENP020439 vlCDR2
GASSRAT

SEQ ID NO: 7594 - protein, 9 aa, Artificial Sequence
  Description of Artificial Sequence: Synthetic peptide
  XENP020439 vlCDR3
QQYGSSPWT

SEQ ID NO: 7595 - protein, 221 aa, Artificial Sequence
  Description of Artificial Sequence: Synthetic polypeptide
  XENP009950 [CTLA-4]_H0_L0_Fab_Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7596 - protein, 118 aa, Artificial Sequence; identical to SEQ ID NO: 3737
  Description of Artificial Sequence: Synthetic polypeptide
  VH of XENP009950

SEQ ID NO: 7597 - protein, 5 aa, Artificial Sequence
  Description of Artificial Sequence: Synthetic peptide
  XENP009950 vhCDR1
SYTMH

SEQ ID NO: 7598 - protein, 17 aa, Artificial Sequence
  Description of Artificial Sequence: Synthetic peptide
  XENP009950 vhCDR2
FISYDGNNKYYADSVKG

SEQ ID NO: 7599 - protein, 9 aa, Artificial Sequence
  Description of Artificial Sequence: Synthetic peptide
  XENP009950 vhCDR3
TGWLGPFDY

SEQ ID NO: 7600 - protein, 215 aa, Artificial Sequence
  Description of Artificial Sequence: Synthetic polypeptide
  XENP009950 [CTLA-4]_H0_L0_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7601 - protein, 108 aa, Artificial Sequence; identical to SEQ ID NO: 3741
  Description of Artificial Sequence: Synthetic polypeptide
  VL of XENP009950

SEQ ID NO: 7602 - protein, 12 aa, Artificial Sequence
  Description of Artificial Sequence: Synthetic peptide
  XENP009950 vlCDR1
RASQSVGSSYLA

SEQ ID NO: 7603 - protein, 7 aa, Artificial Sequence
  Description of Artificial Sequence: Synthetic peptide
  XENP009950 vlCDR2
GAFSRAT

SEQ ID NO: 7604 - protein, 9 aa, Artificial Sequence
  Description of Artificial Sequence: Synthetic peptide
  XENP009950 vlCDR3
QQYGSSPWT

SEQ ID NO: 7605 - protein, 221 aa, Artificial Sequence
  Description of Artificial Sequence: Synthetic polypeptide
  XENP019211 [CTLA-4]_H0.1_L0_Fab Heavy Chain
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7606 - protein, 118 aa, Artificial Sequence; identical to SEQ ID NO: 4869
  Description of Artificial Sequence: Synthetic polypeptide
  VH of XENP019211

SEQ ID NO: 7607 - protein, 5 aa, Artificial Sequence
  Description of Artificial Sequence: Synthetic peptide
  XENP019211 vhCDR1
SYTMH

SEQ ID NO: 7608 - protein, 17 aa, Artificial Sequence
  Description of Artificial Sequence: Synthetic peptide
  XENP019211 vhCDR2
FISYDGNNKYYADSVKG

SEQ ID NO: 7609 - protein, 9 aa, Artificial Sequence
  Description of Artificial Sequence: Synthetic peptide
  XENP019211 vhCDR3
TGWLGPFDY

SEQ ID NO: 7610 - protein, 215 aa, Artificial Sequence; identical to SEQ ID NO: 7600
  Description of Artificial Sequence: Synthetic polypeptide
  XENP019211 [CTLA-4]_H0.1_L0_Fab Light Chain

SEQ ID NO: 7611 - protein, 108 aa, Artificial Sequence; identical to SEQ ID NO: 3741
  Description of Artificial Sequence: Synthetic polypeptide
  VL of XENP019211

SEQ ID NO: 7612 - protein, 12 aa, Artificial Sequence
  Description of Artificial Sequence: Synthetic peptide
  XENP019211 vlCDR1
RASQSVGSSYLA

SEQ ID NO: 7613 - protein, 7 aa, Artificial Sequence
  Description of Artificial Sequence: Synthetic peptide
  XENP019211 vlCDR2
GAFSRAT

SEQ ID NO: 7614 - protein, 9 aa, Artificial Sequence
  Description of Artificial Sequence: Synthetic peptide
  XENP019211 vlCDR3
QQYGSSPWT

SEQ ID NO: 7615 - protein, 221 aa, Artificial Sequence
  Description of Artificial Sequence: Synthetic polypeptide
  XENP019212 [CTLA-4]_H0.2_L0_Fab Heavy Chain
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7616 - protein, 118 aa, Artificial Sequence; identical to SEQ ID NO: 4878
  Description of Artificial Sequence: Synthetic polypeptide
  VH of XENP019212

SEQ ID NO: 7617 - protein, 5 aa, Artificial Sequence
  Description of Artificial Sequence: Synthetic peptide
  XENP019212 vhCDR1
SYTMH

SEQ ID NO: 7618 - protein, 17 aa, Artificial Sequence
  Description of Artificial Sequence: Synthetic peptide
  XENP019212 vhCDR2
FISYDGNNKYYADSVKG

SEQ ID NO: 7619 - protein, 9 aa, Artificial Sequence
  Description of Artificial Sequence: Synthetic peptide
  XENP019212 vhCDR3
TGWLGPFDY

SEQ ID NO: 7620 - protein, 215 aa, Artificial Sequence; identical to SEQ ID NO: 7600
  Description of Artificial Sequence: Synthetic polypeptide
  XENP019212 [CTLA-4]_H0.2_L0_Fab Light Chain

SEQ ID NO: 7621 - protein, 108 aa, Artificial Sequence; identical to SEQ ID NO: 3741
  Description of Artificial Sequence: Synthetic polypeptide
  VL of XENP019212

SEQ ID NO: 7622 - protein, 12 aa, Artificial Sequence
  Description of Artificial Sequence: Synthetic peptide
  XENP019212 vlCDR1
RASQSVGSSYLA

SEQ ID NO: 7623 - protein, 7 aa, Artificial Sequence
  Description of Artificial Sequence: Synthetic peptide
  XENP019212 vlCDR2
GAFSRAT

SEQ ID NO: 7624 - protein, 9 aa, Artificial Sequence
  Description of Artificial Sequence: Synthetic peptide
  XENP019212 vlCDR3
QQYGSSPWT

SEQ ID NO: 7625 - protein, 221 aa, Artificial Sequence
  Description of Artificial Sequence: Synthetic polypeptide
  XENP019213 [CTLA-4]_H0.3_L0_Fab Heavy Chain
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7626 - protein, 118 aa, Artificial Sequence; identical to SEQ ID NO: 4887
  Description of Artificial Sequence: Synthetic polypeptide
  VH of XENP019213

SEQ ID NO: 7627 - protein, 5 aa, Artificial Sequence
  Description of Artificial Sequence: Synthetic peptide
  XENP019213 vhCDR1
SYTMH

SEQ ID NO: 7628 - protein, 17 aa, Artificial Sequence
  Description of Artificial Sequence: Synthetic peptide
  XENP019213 vhCDR2
FISYDGNNKYYADSVKG

SEQ ID NO: 7629 - protein, 9 aa, Artificial Sequence
  Description of Artificial Sequence: Synthetic peptide
  XENP019213 vhCDR3
TGWLGPFDY

SEQ ID NO: 7630 - protein, 215 aa, Artificial Sequence; identical to SEQ ID NO: 7600
  Description of Artificial Sequence: Synthetic polypeptide
  XENP019213 [CTLA-4]_H0.3_L0_Fab Light Chain

SEQ ID NO: 7631 - protein, 108 aa, Artificial Sequence; identical to SEQ ID NO: 3741
  Description of Artificial Sequence: Synthetic polypeptide
  VL of XENP019213

SEQ ID NO: 7632 - protein, 12 aa, Artificial Sequence
  Description of Artificial Sequence: Synthetic peptide
  XENP019213 vlCDR1
RASQSVGSSYLA

SEQ ID NO: 7633 - protein, 7 aa, Artificial Sequence
  Description of Artificial Sequence: Synthetic peptide
  XENP019213 vlCDR2
GAFSRAT

SEQ ID NO: 7634 - protein, 9 aa, Artificial Sequence
  Description of Artificial Sequence: Synthetic peptide
  XENP019213 vlCDR3
QQYGSSPWT

SEQ ID NO: 7635 - protein, 221 aa, Artificial Sequence
  Description of Artificial Sequence: Synthetic polypeptide
  XENP019214 [CTLA-4]_H0.4_L0_Fab Heavy Chain
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7636 - protein, 118 aa, Artificial Sequence; identical to SEQ ID NO: 4896
  Description of Artificial Sequence: Synthetic polypeptide
  VH of XENP019214

SEQ ID NO: 7637 - protein, 5 aa, Artificial Sequence
  Description of Artificial Sequence: Synthetic peptide
  XENP019214 vhCDR1
SYTMH

SEQ ID NO: 7638 - protein, 17 aa, Artificial Sequence
  Description of Artificial Sequence: Synthetic peptide
  XENP019214 vhCDR2
FISYDGNNKYYADSVKG

SEQ ID NO: 7639 - protein, 9 aa, Artificial Sequence
  Description of Artificial Sequence: Synthetic peptide
  XENP019214 vhCDR3
TGWLGPFDY

SEQ ID NO: 7640 - protein, 215 aa, Artificial Sequence; identical to SEQ ID NO: 7600
  Description of Artificial Sequence: Synthetic polypeptide
  XENP019214 [CTLA-4]_H0.4_L0_Fab Light Chain

SEQ ID NO: 7641 - protein, 108 aa, Artificial Sequence; identical to SEQ ID NO: 3741
  Description of Artificial Sequence: Synthetic polypeptide
  VL of XENP019214

SEQ ID NO: 7642 - protein, 12 aa, Artificial Sequence
  Description of Artificial Sequence: Synthetic peptide
  XENP019214 vlCDR1
RASQSVGSSYLA

SEQ ID NO: 7643 - protein, 7 aa, Artificial Sequence
  Description of Artificial Sequence: Synthetic peptide
  XENP019214 vlCDR2
GAFSRAT

SEQ ID NO: 7644 - protein, 9 aa, Artificial Sequence
  Description of Artificial Sequence: Synthetic peptide
  XENP019214 vlCDR3
QQYGSSPWT

SEQ ID NO: 7645 - protein, 221 aa, Artificial Sequence
  Description of Artificial Sequence: Synthetic polypeptide
  XENP019215 [CTLA-4]_H0.5_L0_Fab Heavy Chain
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7646 - protein, 118 aa, Artificial Sequence; identical to SEQ ID NO: 4905
  Description of Artificial Sequence: Synthetic polypeptide
  VH of XENP019215

SEQ ID NO: 7647 - protein, 5 aa, Artificial Sequence
  Description of Artificial Sequence: Synthetic peptide
  XENP019215 vhCDR1
SYTMH

SEQ ID NO: 7648 - protein, 17 aa, Artificial Sequence
  Description of Artificial Sequence: Synthetic peptide
  XENP019215 vhCDR2
FISYDGNNKYYADSVKG

SEQ ID NO: 7649 - protein, 9 aa, Artificial Sequence
  Description of Artificial Sequence: Synthetic peptide
  XENP019215 vhCDR3
TGWLGPFDY

SEQ ID NO: 7650 - protein, 215 aa, Artificial Sequence; identical to SEQ ID NO: 7600
  Description of Artificial Sequence: Synthetic polypeptide
  XENP019215 [CTLA-4]_H0.5_L0_Fab Light Chain

SEQ ID NO: 7651 - protein, 108 aa, Artificial Sequence; identical to SEQ ID NO: 3741
  Description of Artificial Sequence: Synthetic polypeptide
  VL of XENP019215

SEQ ID NO: 7652 - protein, 12 aa, Artificial Sequence
  Description of Artificial Sequence: Synthetic peptide
  XENP019215 vlCDR1
RASQSVGSSYLA

SEQ ID NO: 7653 - protein, 7 aa, Artificial Sequence
  Description of Artificial Sequence: Synthetic peptide
  XENP019215 vlCDR2
GAFSRAT

SEQ ID NO: 7654 - protein, 9 aa, Artificial Sequence
  Description of Artificial Sequence: Synthetic peptide
  XENP019215 vlCDR3
QQYGSSPWT

SEQ ID NO: 7655 - protein, 221 aa, Artificial Sequence
  Description of Artificial Sequence: Synthetic polypeptide
  XENP019216 [CTLA-4]_H0.6_L0_Fab Heavy Chain
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7656 - protein, 118 aa, Artificial Sequence; identical to SEQ ID NO: 4914
  Description of Artificial Sequence: Synthetic polypeptide
  VH of XENP019216

SEQ ID NO: 7657 - protein, 5 aa, Artificial Sequence
  Description of Artificial Sequence: Synthetic peptide
  XENP019216 vhCDR1
SYTMH

SEQ ID NO: 7658 - protein, 17 aa, Artificial Sequence
  Description of Artificial Sequence: Synthetic peptide
  XENP019216 vhCDR2
FISYDGNNKYYADSVKG

SEQ ID NO: 7659 - protein, 9 aa, Artificial Sequence
  Description of Artificial Sequence: Synthetic peptide
  XENP019216 vhCDR3
TGWLGPFDY

SEQ ID NO: 7660 - protein, 215 aa, Artificial Sequence; identical to SEQ ID NO: 7600
  Description of Artificial Sequence: Synthetic polypeptide
  XENP019216 [CTLA-4]_H0.6_L0_Fab Light Chain

SEQ ID NO: 7661 - protein, 108 aa, Artificial Sequence; identical to SEQ ID NO: 3741
  Description of Artificial Sequence: Synthetic polypeptide
  VL of XENP019216

SEQ ID NO: 7662 - protein, 12 aa, Artificial Sequence
  Description of Artificial Sequence: Synthetic peptide
  XENP019216 vlCDR1
RASQSVGSSYLA

SEQ ID NO: 7663 - protein, 7 aa, Artificial Sequence
  Description of Artificial Sequence: Synthetic peptide
  XENP019216 vlCDR2
GAFSRAT

SEQ ID NO: 7664 - protein, 9 aa, Artificial Sequence
  Description of Artificial Sequence: Synthetic peptide
  XENP019216 vlCDR3
QQYGSSPWT

SEQ ID NO: 7665 - protein, 221 aa, Artificial Sequence
  Description of Artificial Sequence: Synthetic polypeptide
  XENP019217 [CTLA-4]_H0.7_L0_Fab Heavy Chain
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7666 - protein, 118 aa, Artificial Sequence; identical to SEQ ID NO: 4923
  Description of Artificial Sequence: Synthetic polypeptide
  VH of XENP019217

SEQ ID NO: 7667 - protein, 5 aa, Artificial Sequence
  Description of Artificial Sequence: Synthetic peptide
  XENP019217 vhCDR1
SYTMH

SEQ ID NO: 7668 - protein, 17 aa, Artificial Sequence
  Description of Artificial Sequence: Synthetic peptide
  XENP019217 vhCDR2
FISYDGNNKYYADSVKG

SEQ ID NO: 7669 - protein, 9 aa, Artificial Sequence
  Description of Artificial Sequence: Synthetic peptide
  XENP019217 vhCDR3
TGWLGPFDY

SEQ ID NO: 7670 - protein, 215 aa, Artificial Sequence; identical to SEQ ID NO: 7600
  Description of Artificial Sequence: Synthetic polypeptide
  XENP019217 [CTLA-4]_H0.7_L0_Fab Light Chain

SEQ ID NO: 7671 - protein, 108 aa, Artificial Sequence; identical to SEQ ID NO: 3741
  Description of Artificial Sequence: Synthetic polypeptide
  VL of XENP019217

SEQ ID NO: 7672 - protein, 12 aa, Artificial Sequence
  Description of Artificial Sequence: Synthetic peptide
  XENP019217 vlCDR1
RASQSVGSSYLA

SEQ ID NO: 7673 - protein, 7 aa, Artificial Sequence
  Description of Artificial Sequence: Synthetic peptide
  XENP019217 vlCDR2
GAFSRAT

SEQ ID NO: 7674 - protein, 9 aa, Artificial Sequence
  Description of Artificial Sequence: Synthetic peptide
  XENP019217 vlCDR3
QQYGSSPWT

SEQ ID NO: 7675 - protein, 221 aa, Artificial Sequence
  Description of Artificial Sequence: Synthetic polypeptide
  XENP019218 [CTLA-4]_H0.8_L0_Fab Heavy Chain
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7676 - protein, 118 aa, Artificial Sequence; identical to SEQ ID NO: 4932
  Description of Artificial Sequence: Synthetic polypeptide
  VH of XENP019218

SEQ ID NO: 7677 - protein, 5 aa, Artificial Sequence
  Description of Artificial Sequence: Synthetic peptide
  XENP019218 vhCDR1
SYTMH

SEQ ID NO: 7678 - protein, 17 aa, Artificial Sequence
  Description of Artificial Sequence: Synthetic peptide
  XENP019218 vhCDR2
FISYDGNNKYYADSVKG

SEQ ID NO: 7679 - protein, 9 aa, Artificial Sequence
  Description of Artificial Sequence: Synthetic peptide
  XENP019218 vhCDR3
TGWLGPFDY

SEQ ID NO: 7680 - protein, 215 aa, Artificial Sequence; identical to SEQ ID NO: 7600
  Description of Artificial Sequence: Synthetic polypeptide
  XENP019218 [CTLA-4]_H0.8_L0_Fab Light Chain

SEQ ID NO: 7681 - protein, 108 aa, Artificial Sequence; identical to SEQ ID NO: 3741
  Description of Artificial Sequence: Synthetic polypeptide
  VL of XENP019218

SEQ ID NO: 7682 - protein, 12 aa, Artificial Sequence
  Description of Artificial Sequence: Synthetic peptide
  XENP019218 vlCDR1
RASQSVGSSYLA

SEQ ID NO: 7683 - protein, 7 aa, Artificial Sequence
  Description of Artificial Sequence: Synthetic peptide
  XENP019218 vlCDR2
GAFSRAT

SEQ ID NO: 7684 - protein, 9 aa, Artificial Sequence
  Description of Artificial Sequence: Synthetic peptide
  XENP019218 vlCDR3
QQYGSSPWT

SEQ ID NO: 7685 - protein, 221 aa, Artificial Sequence
  Description of Artificial Sequence: Synthetic polypeptide
  XENP019219 [CTLA-4]_H0.9_L0_Fab Heavy Chain
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7686 - protein, 118 aa, Artificial Sequence; identical to SEQ ID NO: 4941
  Description of Artificial Sequence: Synthetic polypeptide
  VH of XENP019219

SEQ ID NO: 7687 - protein, 5 aa, Artificial Sequence
  Description of Artificial Sequence: Synthetic peptide
  XENP019219 vhCDR1
SYTMH

SEQ ID NO: 7688 - protein, 17 aa, Artificial Sequence
  Description of Artificial Sequence: Synthetic peptide
  XENP019219 vhCDR2
FISYDGNNKYYADSVKG

SEQ ID NO: 7689 - protein, 9 aa, Artificial Sequence
  Description of Artificial Sequence: Synthetic peptide
  XENP019219 vhCDR3
TGWLGPFDY

SEQ ID NO: 7690 - protein, 215 aa, Artificial Sequence; identical to SEQ ID NO: 7600
  Description of Artificial Sequence: Synthetic polypeptide
  XENP019219 [CTLA-4]_H0.9_L0_Fab Light Chain

SEQ ID NO: 7691 - protein, 108 aa, Artificial Sequence; identical to SEQ ID NO: 3741
  Description of Artificial Sequence: Synthetic polypeptide
  VL of XENP019219

SEQ ID NO: 7692 - protein, 12 aa, Artificial Sequence
  Description of Artificial Sequence: Synthetic peptide
  XENP019219 vlCDR1
RASQSVGSSYLA

SEQ ID NO: 7693 - protein, 7 aa, Artificial Sequence
  Description of Artificial Sequence: Synthetic peptide
  XENP019219 vlCDR2
GAFSRAT

SEQ ID NO: 7694 - protein, 9 aa, Artificial Sequence
  Description of Artificial Sequence: Synthetic peptide
  XENP019219 vlCDR3
QQYGSSPWT

SEQ ID NO: 7695 - protein, 221 aa, Artificial Sequence
  Description of Artificial Sequence: Synthetic polypeptide
  XENP019220 [CTLA-4]_H0.10_L0_Fab Heavy Chain
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7696 - protein, 118 aa, Artificial Sequence; identical to SEQ ID NO: 4950
  Description of Artificial Sequence: Synthetic polypeptide
  VH of XENP019220

SEQ ID NO: 7697 - protein, 5 aa, Artificial Sequence
  Description of Artificial Sequence: Synthetic peptide
  XENP019220 vhCDR1
SYTMH

SEQ ID NO: 7698 - protein, 17 aa, Artificial Sequence
  Description of Artificial Sequence: Synthetic peptide
  XENP019220 vhCDR2
FISYDGNNKYYADSVKG

SEQ ID NO: 7699 - protein, 9 aa, Artificial Sequence
  Description of Artificial Sequence: Synthetic peptide
  XENP019220 vhCDR3
TGWLGPFDY

SEQ ID NO: 7700 - protein, 215 aa, Artificial Sequence; identical to SEQ ID NO: 7600
  Description of Artificial Sequence: Synthetic polypeptide
  XENP019220 [CTLA-4]_H0.10_L0_Fab Light Chain

SEQ ID NO: 7701 - protein, 108 aa, Artificial Sequence; identical to SEQ ID NO: 3741
  Description of Artificial Sequence: Synthetic polypeptide
  VL of XENP019220

SEQ ID NO: 7702 - protein, 12 aa, Artificial Sequence
  Description of Artificial Sequence: Synthetic peptide
  XENP019220 vlCDR1
RASQSVGSSYLA

SEQ ID NO: 7703 - protein, 7 aa, Artificial Sequence
  Description of Artificial Sequence: Synthetic peptide
  XENP019220 vlCDR2
GAFSRAT

SEQ ID NO: 7704 - protein, 9 aa, Artificial Sequence
  Description of Artificial Sequence: Synthetic peptide
  XENP019220 vlCDR3
QQYGSSPWT

SEQ ID NO: 7705 - protein, 221 aa, Artificial Sequence
  Description of Artificial Sequence: Synthetic polypeptide
  XENP019221 [CTLA-4]_H0.11_L0_Fab Heavy Chain
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7706 - protein, 118 aa, Artificial Sequence; identical to SEQ ID NO: 4959
  Description of Artificial Sequence: Synthetic polypeptide
  VH of XENP019221

SEQ ID NO: 7707 - protein, 5 aa, Artificial Sequence
  Description of Artificial Sequence: Synthetic peptide
  XENP019221 vhCDR1
SYTMH

SEQ ID NO: 7708 - protein, 17 aa, Artificial Sequence
  Description of Artificial Sequence: Synthetic peptide
  XENP019221 vhCDR2
FISYDGNNKYYADSVKG

SEQ ID NO: 7709 - protein, 9 aa, Artificial Sequence
  Description of Artificial Sequence: Synthetic peptide
  XENP019221 vhCDR3
TGWLGPFDY

SEQ ID NO: 7710 - protein, 215 aa, Artificial Sequence; identical to SEQ ID NO: 7600
  Description of Artificial Sequence: Synthetic polypeptide
  XENP019221 [CTLA-4]_H0.11_L0_Fab Light Chain

SEQ ID NO: 7711 - protein, 108 aa, Artificial Sequence; identical to SEQ ID NO: 3741
  Description of Artificial Sequence: Synthetic polypeptide
  VL of XENP019221

SEQ ID NO: 7712 - protein, 12 aa, Artificial Sequence
  Description of Artificial Sequence: Synthetic peptide
  XENP019221 vlCDR1
RASQSVGSSYLA

SEQ ID NO: 7713 - protein, 7 aa, Artificial Sequence
  Description of Artificial Sequence: Synthetic peptide
  XENP019221 vlCDR2
GAFSRAT

SEQ ID NO: 7714 - protein, 9 aa, Artificial Sequence
  Description of Artificial Sequence: Synthetic peptide
  XENP019221 vlCDR3
QQYGSSPWT

SEQ ID NO: 7715 - protein, 221 aa, Artificial Sequence
  Description of Artificial Sequence: Synthetic polypeptide
  XENP019222 [CTLA-4]_H0.12_L0_Fab Heavy Chain
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7716 - protein, 118 aa, Artificial Sequence; identical to SEQ ID NO: 4968
  Description of Artificial Sequence: Synthetic polypeptide
  VH of XENP019222

SEQ ID NO: 7717 - protein, 5 aa, Artificial Sequence
  Description of Artificial Sequence: Synthetic peptide
  XENP019222 vhCDR1
AYTMH

SEQ ID NO: 7718 - protein, 17 aa, Artificial Sequence
  Description of Artificial Sequence: Synthetic peptide
  XENP019222 vhCDR2
FISYDGNNKYYADSVKG

SEQ ID NO: 7719 - protein, 9 aa, Artificial Sequence
  Description of Artificial Sequence: Synthetic peptide
  XENP019222 vhCDR3
TGWLGPFDY

SEQ ID NO: 7720 - protein, 215 aa, Artificial Sequence; identical to SEQ ID NO: 7600
  Description of Artificial Sequence: Synthetic polypeptide
  XENP019222 [CTLA-4]_H0.12_L0_Fab Light Chain

SEQ ID NO: 7721 - protein, 108 aa, Artificial Sequence; identical to SEQ ID NO: 3741
  Description of Artificial Sequence: Synthetic polypeptide
  VL of XENP019222

SEQ ID NO: 7722 - protein, 12 aa, Artificial Sequence
  Description of Artificial Sequence: Synthetic peptide
  XENP019222 vlCDR1
RASQSVGSSYLA

SEQ ID NO: 7723 - protein, 7 aa, Artificial Sequence
  Description of Artificial Sequence: Synthetic peptide
  XENP019222 vlCDR2
GAFSRAT

SEQ ID NO: 7724 - protein, 9 aa, Artificial Sequence
  Description of Artificial Sequence: Synthetic peptide
  XENP019222 vlCDR3
QQYGSSPWT

SEQ ID NO: 7725 - protein, 221 aa, Artificial Sequence
  Description of Artificial Sequence: Synthetic polypeptide
  XENP019223 [CTLA-4]_H0.13_L0_Fab Heavy Chain
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7726 - protein, 118 aa, Artificial Sequence; identical to SEQ ID NO: 4977
  Description of Artificial Sequence: Synthetic polypeptide
  VH of XENP019223

SEQ ID NO: 7727 - protein, 5 aa, Artificial Sequence
  Description of Artificial Sequence: Synthetic peptide
  XENP019223 vhCDR1
DYTMH

SEQ ID NO: 7728 - protein, 17 aa, Artificial Sequence
  Description of Artificial Sequence: Synthetic peptide
  XENP019223 vhCDR2
FISYDGNNKYYADSVKG

SEQ ID NO: 7729 - protein, 9 aa, Artificial Sequence
  Description of Artificial Sequence: Synthetic peptide
  XENP019223 vhCDR3
TGWLGPFDY

SEQ ID NO: 7730 - protein, 215 aa, Artificial Sequence; identical to SEQ ID NO: 7600
  Description of Artificial Sequence: Synthetic polypeptide
  XENP019223 [CTLA-4]_H0.13_L0_Fab Light Chain

SEQ ID NO: 7731 - protein, 108 aa, Artificial Sequence; identical to SEQ ID NO: 3741
  Description of Artificial Sequence: Synthetic polypeptide
  VL of XENP019223

SEQ ID NO: 7732 - protein, 12 aa, Artificial Sequence
  Description of Artificial Sequence: Synthetic peptide
  XENP019223 vlCDR1
RASQSVGSSYLA

SEQ ID NO: 7733 - protein, 7 aa, Artificial Sequence
  Description of Artificial Sequence: Synthetic peptide
  XENP019223 vlCDR2
GAFSRAT

SEQ ID NO: 7734 - protein, 9 aa, Artificial Sequence
  Description of Artificial Sequence: Synthetic peptide
  XENP019223 vlCDR3
QQYGSSPWT

SEQ ID NO: 7735 - protein, 221 aa, Artificial Sequence
  Description of Artificial Sequence: Synthetic polypeptide
  XENP019224 [CTLA-4]_H0.14_L0_Fab Heavy Chain
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7736 - protein, 118 aa, Artificial Sequence; identical to SEQ ID NO: 4986
  Description of Artificial Sequence: Synthetic polypeptide
  VH of XENP019224

SEQ ID NO: 7737 - protein, 5 aa, Artificial Sequence
  Description of Artificial Sequence: Synthetic peptide
  XENP019224 vhCDR1
GYTMH

SEQ ID NO: 7738 - protein, 17 aa, Artificial Sequence
  Description of Artificial Sequence: Synthetic peptide
  XENP019224 vhCDR2
FISYDGNNKYYADSVKG

SEQ ID NO: 7739 - protein, 9 aa, Artificial Sequence
  Description of Artificial Sequence: Synthetic peptide
  XENP019224 vhCDR3
TGWLGPFDY

SEQ ID NO: 7740 - protein, 215 aa, Artificial Sequence; identical to SEQ ID NO: 7600
  Description of Artificial Sequence: Synthetic polypeptide
  XENP019224 [CTLA-4]_H0.14_L0_Fab Light Chain

SEQ ID NO: 7741 - protein, 108 aa, Artificial Sequence; identical to SEQ ID NO: 3741
  Description of Artificial Sequence: Synthetic polypeptide
  VL of XENP019224

SEQ ID NO: 7742 - protein, 12 aa, Artificial Sequence
  Description of Artificial Sequence: Synthetic peptide
  XENP019224 vlCDR1
RASQSVGSSYLA

SEQ ID NO: 7743 - protein, 7 aa, Artificial Sequence
  Description of Artificial Sequence: Synthetic peptide
  XENP019224 vlCDR2
GAFSRAT

SEQ ID NO: 7744 - protein, 9 aa, Artificial Sequence
  Description of Artificial Sequence: Synthetic peptide
  XENP019224 vlCDR3
QQYGSSPWT

SEQ ID NO: 7745 - protein, 221 aa, Artificial Sequence
  Description of Artificial Sequence: Synthetic polypeptide
  XENP019225 [CTLA-4]_H0.15_L0_Fab Heavy Chain
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7746 - protein, 118 aa, Artificial Sequence; identical to SEQ ID NO: 4995
  Description of Artificial Sequence: Synthetic polypeptide
  VH of XENP019225

SEQ ID NO: 7747 - protein, 5 aa, Artificial Sequence
  Description of Artificial Sequence: Synthetic peptide
  XENP019225 vhCDR1
NYTMH

SEQ ID NO: 7748 - protein, 17 aa, Artificial Sequence
  Description of Artificial Sequence: Synthetic peptide
  XENP019225 vhCDR2
FISYDGNNKYYADSVKG

SEQ ID NO: 7749 - protein, 9 aa, Artificial Sequence
  Description of Artificial Sequence: Synthetic peptide
  XENP019225 vhCDR3
TGWLGPFDY

SEQ ID NO: 7750 - protein, 215 aa, Artificial Sequence; identical to SEQ ID NO: 7600
  Description of Artificial Sequence: Synthetic polypeptide
  XENP019225 [CTLA-4]_H0.15_L0_Fab Light Chain

SEQ ID NO: 7751 - protein, 108 aa, Artificial Sequence; identical to SEQ ID NO: 3741
  Description of Artificial Sequence: Synthetic polypeptide
  VL of XENP019225

SEQ ID NO: 7752 - protein, 12 aa, Artificial Sequence
  Description of Artificial Sequence: Synthetic peptide
  XENP019225 vlCDR1
RASQSVGSSYLA

SEQ ID NO: 7753 - protein, 7 aa, Artificial Sequence
  Description of Artificial Sequence: Synthetic peptide
  XENP019225 vlCDR2
GAFSRAT

SEQ ID NO: 7754 - protein, 9 aa, Artificial Sequence
  Description of Artificial Sequence: Synthetic peptide
  XENP019225 vlCDR3
QQYGSSPWT

SEQ ID NO: 7755 - protein, 221 aa, Artificial Sequence
  Description of Artificial Sequence: Synthetic polypeptide
  XENP019226 [CTLA-4]_H0.16_L0_Fab Heavy Chain
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7756 - protein, 118 aa, Artificial Sequence; identical to SEQ ID NO: 5004
  Description of Artificial Sequence: Synthetic polypeptide
  VH of XENP019226

SEQ ID NO: 7757 - protein, 5 aa, Artificial Sequence
  Description of Artificial Sequence: Synthetic peptide
  XENP019226 vhCDR1
QYTMH

SEQ ID NO: 7758 - protein, 17 aa, Artificial Sequence
  Description of Artificial Sequence: Synthetic peptide
  XENP019226 vhCDR2
FISYDGNNKYYADSVKG

SEQ ID NO: 7759 - protein, 9 aa, Artificial Sequence
  Description of Artificial Sequence: Synthetic peptide
  XENP019226 vhCDR3
TGWLGPFDY

SEQ ID NO: 7760 - protein, 215 aa, Artificial Sequence; identical to SEQ ID NO: 7600
  Description of Artificial Sequence: Synthetic polypeptide
  XENP019226 [CTLA-4]_H0.16_L0_Fab Light Chain

SEQ ID NO: 7761 - protein, 108 aa, Artificial Sequence; identical to SEQ ID NO: 3741
  Description of Artificial Sequence: Synthetic polypeptide
  VL of XENP019226

SEQ ID NO: 7762 - protein, 12 aa, Artificial Sequence
  Description of Artificial Sequence: Synthetic peptide
  XENP019226 vlCDR1
RASQSVGSSYLA

SEQ ID NO: 7763 - protein, 7 aa, Artificial Sequence
  Description of Artificial Sequence: Synthetic peptide
  XENP019226 vlCDR2
GAFSRAT

SEQ ID NO: 7764 - protein, 9 aa, Artificial Sequence
  Description of Artificial Sequence: Synthetic peptide
  XENP019226 vlCDR3
QQYGSSPWT

SEQ ID NO: 7765 - protein, 221 aa, Artificial Sequence
  Description of Artificial Sequence: Synthetic polypeptide
  XENP019227 [CTLA-4]_H0.17_L0_Fab Heavy Chain
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7766 - protein, 118 aa, Artificial Sequence; identical to SEQ ID NO: 5013
  Description of Artificial Sequence: Synthetic polypeptide
  VH of XENP019227

SEQ ID NO: 7767 - protein, 5 aa, Artificial Sequence
  Description of Artificial Sequence: Synthetic peptide
  XENP019227 vhCDR1
TYTMH

SEQ ID NO: 7768 - protein, 17 aa, Artificial Sequence
  Description of Artificial Sequence: Synthetic peptide
  XENP019227 vhCDR2
FISYDGNNKYYADSVKG

SEQ ID NO: 7769 - protein, 9 aa, Artificial Sequence
  Description of Artificial Sequence: Synthetic peptide
  XENP019227 vhCDR3
TGWLGPFDY

SEQ ID NO: 7770 - protein, 215 aa, Artificial Sequence; identical to SEQ ID NO: 7600
  Description of Artificial Sequence: Synthetic polypeptide
  XENP019227 [CTLA-4]_H0.17_L0_Fab Light Chain

SEQ ID NO: 7771 - protein, 108 aa, Artificial Sequence; identical to SEQ ID NO: 3741
  Description of Artificial Sequence: Synthetic polypeptide
  VL of XENP019227

SEQ ID NO: 7772 - protein, 12 aa, Artificial Sequence
  Description of Artificial Sequence: Synthetic peptide
  XENP019227 vlCDR1
RASQSVGSSYLA

SEQ ID NO: 7773 - protein, 7 aa, Artificial Sequence
  Description of Artificial Sequence: Synthetic peptide
  XENP019227 vlCDR2
GAFSRAT

SEQ ID NO: 7774 - protein, 9 aa, Artificial Sequence
  Description of Artificial Sequence: Synthetic peptide
  XENP019227 vlCDR3
QQYGSSPWT

SEQ ID NO: 7775 - protein, 221 aa, Artificial Sequence
  Description of Artificial Sequence: Synthetic polypeptide
  XENP019228 [CTLA-4]_H0.18_L0_Fab Heavy Chain
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7776 - protein, 118 aa, Artificial Sequence; identical to SEQ ID NO: 5022
  Description of Artificial Sequence: Synthetic polypeptide
  VH of XENP019228

SEQ ID NO: 7777 - protein, 5 aa, Artificial Sequence
  Description of Artificial Sequence: Synthetic peptide
  XENP019228 vhCDR1
SATMH

SEQ ID NO: 7778 - protein, 17 aa, Artificial Sequence
  Description of Artificial Sequence: Synthetic peptide
  XENP019228 vhCDR2
FISYDGNNKYYADSVKG

SEQ ID NO: 7779 - protein, 9 aa, Artificial Sequence
  Description of Artificial Sequence: Synthetic peptide
  XENP019228 vhCDR3
TGWLGPFDY

SEQ ID NO: 7780 - protein, 215 aa, Artificial Sequence; identical to SEQ ID NO: 7600
  Description of Artificial Sequence: Synthetic polypeptide
  XENP019228 [CTLA-4]_H0.18_L0_Fab Light Chain

SEQ ID NO: 7781 - protein, 108 aa, Artificial Sequence; identical to SEQ ID NO: 3741
  Description of Artificial Sequence: Synthetic polypeptide
  VL of XENP019228

SEQ ID NO: 7782 - protein, 12 aa, Artificial Sequence
  Description of Artificial Sequence: Synthetic peptide
  XENP019228 vlCDR1
RASQSVGSSYLA

SEQ ID NO: 7783 - protein, 7 aa, Artificial Sequence
  Description of Artificial Sequence: Synthetic peptide
  XENP019228 vlCDR2
GAFSRAT

SEQ ID NO: 7784 - protein, 9 aa, Artificial Sequence
  Description of Artificial Sequence: Synthetic peptide
  XENP019228 vlCDR3
QQYGSSPWT

SEQ ID NO: 7785 - protein, 221 aa, Artificial Sequence
  Description of Artificial Sequence: Synthetic polypeptide
  XENP019229 [CTLA-4]_H0.19_L0_Fab Heavy Chain
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7786 - protein, 118 aa, Artificial Sequence; identical to SEQ ID NO: 5031
  Description of Artificial Sequence: Synthetic polypeptide
  VH of XENP019229

SEQ ID NO: 7787 - protein, 5 aa, Artificial Sequence
  Description of Artificial Sequence: Synthetic peptide
  XENP019229 vhCDR1
SHTMH

SEQ ID NO: 7788 - protein, 17 aa, Artificial Sequence
  Description of Artificial Sequence: Synthetic peptide
  XENP019229 vhCDR2
FISYDGNNKYYADSVKG

SEQ ID NO: 7789 - protein, 9 aa, Artificial Sequence
  Description of Artificial Sequence: Synthetic peptide
  XENP019229 vhCDR3
TGWLGPFDY

SEQ ID NO: 7790 - protein, 215 aa, Artificial Sequence; identical to SEQ ID NO: 7600
  Description of Artificial Sequence: Synthetic polypeptide
  XENP019229 [CTLA-4]_H0.19_L0_Fab Light Chain

SEQ ID NO: 7791 - protein, 108 aa, Artificial Sequence; identical to SEQ ID NO: 3741
  Description of Artificial Sequence: Synthetic polypeptide
  VL of XENP019229

SEQ ID NO: 7792 - protein, 12 aa, Artificial Sequence
  Description of Artificial Sequence: Synthetic peptide
  XENP019229 vlCDR1
RASQSVGSSYLA

SEQ ID NO: 7793 - protein, 7 aa, Artificial Sequence
  Description of Artificial Sequence: Synthetic peptide
  XENP019229 vlCDR2
GAFSRAT

SEQ ID NO: 7794 - protein, 9 aa, Artificial Sequence
  Description of Artificial Sequence: Synthetic peptide
  XENP019229 vlCDR3
QQYGSSPWT

SEQ ID NO: 7795 - protein, 221 aa, Artificial Sequence
  Description of Artificial Sequence: Synthetic polypeptide
  XENP019230 [CTLA-4]_H0.20_L0_Fab Heavy Chain
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7796 - protein, 118 aa, Artificial Sequence; identical to SEQ ID NO: 5040
  Description of Artificial Sequence: Synthetic polypeptide
  VH of XENP019230

SEQ ID NO: 7797 - protein, 5 aa, Artificial Sequence
  Description of Artificial Sequence: Synthetic peptide
  XENP019230 vhCDR1
SFTMH

SEQ ID NO: 7798 - protein, 17 aa, Artificial Sequence
  Description of Artificial Sequence: Synthetic peptide
  XENP019230 vhCDR2
FISYDGNNKYYADSVKG

SEQ ID NO: 7799 - protein, 9 aa, Artificial Sequence
  Description of Artificial Sequence: Synthetic peptide
  XENP019230 vhCDR3
TGWLGPFDY

SEQ ID NO: 7800 - protein, 215 aa, Artificial Sequence; identical to SEQ ID NO: 7600
  Description of Artificial Sequence: Synthetic polypeptide
  XENP019230 [CTLA-4]_H0.20_L0_Fab Light Chain

SEQ ID NO: 7801 - protein, 108 aa, Artificial Sequence; identical to SEQ ID NO: 3741
  Description of Artificial Sequence: Synthetic polypeptide
  VL of XENP019230

SEQ ID NO: 7802 - protein, 12 aa, Artificial Sequence
  Description of Artificial Sequence: Synthetic peptide
  XENP019230 vlCDR1
RASQSVGSSYLA

SEQ ID NO: 7803 - protein, 7 aa, Artificial Sequence
  Description of Artificial Sequence: Synthetic peptide
  XENP019230 vlCDR2
GAFSRAT

SEQ ID NO: 7804 - protein, 9 aa, Artificial Sequence
  Description of Artificial Sequence: Synthetic peptide
  XENP019230 vlCDR3
QQYGSSPWT

SEQ ID NO: 7805 - protein, 221 aa, Artificial Sequence
  Description of Artificial Sequence: Synthetic polypeptide
  XENP019231 [CTLA-4]_H0.21_L0_Fab Heavy Chain
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7806 - protein, 118 aa, Artificial Sequence; identical to SEQ ID NO: 5049
  Description of Artificial Sequence: Synthetic polypeptide
  VH of XENP019231

SEQ ID NO: 7807 - protein, 5 aa, Artificial Sequence
  Description of Artificial Sequence: Synthetic peptide
  XENP019231 vhCDR1
SLTMH

SEQ ID NO: 7808 - protein, 17 aa, Artificial Sequence
  Description of Artificial Sequence: Synthetic peptide
  XENP019231 vhCDR2
FISYDGNNKYYADSVKG

SEQ ID NO: 7809 - protein, 9 aa, Artificial Sequence
  Description of Artificial Sequence: Synthetic peptide
  XENP019231 vhCDR3
TGWLGPFDY

SEQ ID NO: 7810 - protein, 215 aa, Artificial Sequence; identical to SEQ ID NO: 7600
  Description of Artificial Sequence: Synthetic polypeptide
  XENP019231 [CTLA-4]_H0.21_L0_Fab Light Chain

SEQ ID NO: 7811 - protein, 108 aa, Artificial Sequence; identical to SEQ ID NO: 3741
  Description of Artificial Sequence: Synthetic polypeptide
  VL of XENP019231

SEQ ID NO: 7812 - protein, 12 aa, Artificial Sequence
  Description of Artificial Sequence: Synthetic peptide
  XENP019231 vlCDR1
RASQSVGSSYLA

SEQ ID NO: 7813 - protein, 7 aa, Artificial Sequence
  Description of Artificial Sequence: Synthetic peptide
  XENP019231 vlCDR2
GAFSRAT

SEQ ID NO: 7814 - protein, 9 aa, Artificial Sequence
  Description of Artificial Sequence: Synthetic peptide
  XENP019231 vlCDR3
QQYGSSPWT

SEQ ID NO: 7815 - protein, 221 aa, Artificial Sequence
  Description of Artificial Sequence: Synthetic polypeptide
  XENP019232 [CTLA-4]_H0.22_L0_Fab Heavy Chain
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7816 - protein, 118 aa, Artificial Sequence; identical to SEQ ID NO: 5058
  Description of Artificial Sequence: Synthetic polypeptide
  VH of XENP019232

SEQ ID NO: 7817 - protein, 5 aa, Artificial Sequence
  Description of Artificial Sequence: Synthetic peptide
  XENP019232 vhCDR1
SNTMH

SEQ ID NO: 7818 - protein, 17 aa, Artificial Sequence
  Description of Artificial Sequence: Synthetic peptide
  XENP019232 vhCDR2
FISYDGNNKYYADSVKG

SEQ ID NO: 7819 - protein, 9 aa, Artificial Sequence
  Description of Artificial Sequence: Synthetic peptide
  XENP019232 vhCDR3
TGWLGPFDY

SEQ ID NO: 7820 - protein, 215 aa, Artificial Sequence; identical to SEQ ID NO: 7600
  Description of Artificial Sequence: Synthetic polypeptide
  XENP019232 [CTLA-4]_H0.22_L0_Fab Light Chain

SEQ ID NO: 7821 - protein, 108 aa, Artificial Sequence; identical to SEQ ID NO: 3741
  Description of Artificial Sequence: Synthetic polypeptide
  VL of XENP019232

SEQ ID NO: 7822 - protein, 12 aa, Artificial Sequence
  Description of Artificial Sequence: Synthetic peptide
  XENP019232 vlCDR1
RASQSVGSSYLA

SEQ ID NO: 7823 - protein, 7 aa, Artificial Sequence
  Description of Artificial Sequence: Synthetic peptide
  XENP019232 vlCDR2
GAFSRAT

SEQ ID NO: 7824 - protein, 9 aa, Artificial Sequence
  Description of Artificial Sequence: Synthetic peptide
  XENP019232 vlCDR3
QQYGSSPWT

SEQ ID NO: 7825 - protein, 221 aa, Artificial Sequence
  Description of Artificial Sequence: Synthetic polypeptide
  XENP019233 [CTLA-4]_H0.23_L0_Fab Heavy Chain
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7826 - protein, 118 aa, Artificial Sequence; identical to SEQ ID NO: 5067
  Description of Artificial Sequence: Synthetic polypeptide
  VH of XENP019233

SEQ ID NO: 7827 - protein, 5 aa, Artificial Sequence
  Description of Artificial Sequence: Synthetic peptide
  XENP019233 vhCDR1
SSTMH

SEQ ID NO: 7828 - protein, 17 aa, Artificial Sequence
  Description of Artificial Sequence: Synthetic peptide
  XENP019233 vhCDR2
FISYDGNNKYYADSVKG

SEQ ID NO: 7829 - protein, 9 aa, Artificial Sequence
  Description of Artificial Sequence: Synthetic peptide
  XENP019233 vhCDR3
TGWLGPFDY

SEQ ID NO: 7830 - protein, 215 aa, Artificial Sequence; identical to SEQ ID NO: 7600
  Description of Artificial Sequence: Synthetic polypeptide
  XENP019233 [CTLA-4]_H0.23_L0_Fab Light Chain

SEQ ID NO: 7831 - protein, 108 aa, Artificial Sequence; identical to SEQ ID NO: 3741
  Description of Artificial Sequence: Synthetic polypeptide
  VL of XENP019233

SEQ ID NO: 7832 - protein, 12 aa, Artificial Sequence
  Description of Artificial Sequence: Synthetic peptide
  XENP019233 vlCDR1
RASQSVGSSYLA

SEQ ID NO: 7833 - protein, 7 aa, Artificial Sequence
  Description of Artificial Sequence: Synthetic peptide
  XENP019233 vlCDR2
GAFSRAT

SEQ ID NO: 7834 - protein, 9 aa, Artificial Sequence
  Description of Artificial Sequence: Synthetic peptide
  XENP019233 vlCDR3
QQYGSSPWT

SEQ ID NO: 7835 - protein, 221 aa, Artificial Sequence
  Description of Artificial Sequence: Synthetic polypeptide
  XENP019234 [CTLA-4]_H0.24_L0_Fab Heavy Chain
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7836 - protein, 118 aa, Artificial Sequence; identical to SEQ ID NO: 5076
  Description of Artificial Sequence: Synthetic polypeptide
  VH of XENP019234

SEQ ID NO: 7837 - protein, 5 aa, Artificial Sequence
  Description of Artificial Sequence: Synthetic peptide
  XENP019234 vhCDR1
SVTMH

SEQ ID NO: 7838 - protein, 17 aa, Artificial Sequence
  Description of Artificial Sequence: Synthetic peptide
  XENP019234 vhCDR2
FISYDGNNKYYADSVKG

SEQ ID NO: 7839 - protein, 9 aa, Artificial Sequence
  Description of Artificial Sequence: Synthetic peptide
  XENP019234 vhCDR3
TGWLGPFDY

SEQ ID NO: 7840 - protein, 215 aa, Artificial Sequence; identical to SEQ ID NO: 7600
  Description of Artificial Sequence: Synthetic polypeptide
  XENP019234 [CTLA-4]_H0.24_L0_Fab Light Chain

SEQ ID NO: 7841 - protein, 108 aa, Artificial Sequence; identical to SEQ ID NO: 3741
  Description of Artificial Sequence: Synthetic polypeptide
  VL of XENP019234

SEQ ID NO: 7842 - protein, 12 aa, Artificial Sequence
  Description of Artificial Sequence: Synthetic peptide
  XENP019234 vlCDR1
RASQSVGSSYLA

SEQ ID NO: 7843 - protein, 7 aa, Artificial Sequence
  Description of Artificial Sequence: Synthetic peptide
  XENP019234 vlCDR2
GAFSRAT

SEQ ID NO: 7844 - protein, 9 aa, Artificial Sequence
  Description of Artificial Sequence: Synthetic peptide
  XENP019234 vlCDR3
QQYGSSPWT

SEQ ID NO: 7845 - protein, 221 aa, Artificial Sequence
  Description of Artificial Sequence: Synthetic polypeptide
  XENP019235 [CTLA-4]_H0.25_L0_Fab Heavy Chain
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7846 - protein, 118 aa, Artificial Sequence; identical to SEQ ID NO: 5085
  Description of Artificial Sequence: Synthetic polypeptide
  VH of XENP019235

SEQ ID NO: 7847 - protein, 5 aa, Artificial Sequence
  Description of Artificial Sequence: Synthetic peptide
  XENP019235 vhCDR1
SYAMH

SEQ ID NO: 7848 - protein, 17 aa, Artificial Sequence
  Description of Artificial Sequence: Synthetic peptide
  XENP019235 vhCDR2
FISYDGNNKYYADSVKG

SEQ ID NO: 7849 - protein, 9 aa, Artificial Sequence
  Description of Artificial Sequence: Synthetic peptide
  XENP019235 vhCDR3
TGWLGPFDY

SEQ ID NO: 7850 - protein, 215 aa, Artificial Sequence; identical to SEQ ID NO: 7600
  Description of Artificial Sequence: Synthetic polypeptide
  XENP019235 [CTLA-4]_H0.25_L0_Fab Light Chain

SEQ ID NO: 7851 - protein, 108 aa, Artificial Sequence; identical to SEQ ID NO: 3741
  Description of Artificial Sequence: Synthetic polypeptide
  VL of XENP019235

SEQ ID NO: 7852 - protein, 12 aa, Artificial Sequence
  Description of Artificial Sequence: Synthetic peptide
  XENP019235 vlCDR1
RASQSVGSSYLA

SEQ ID NO: 7853 - protein, 7 aa, Artificial Sequence
  Description of Artificial Sequence: Synthetic peptide
  XENP019235 vlCDR2
GAFSRAT

SEQ ID NO: 7854 - protein, 9 aa, Artificial Sequence
  Description of Artificial Sequence: Synthetic peptide
  XENP019235 vlCDR3
QQYGSSPWT

SEQ ID NO: 7855 - protein, 221 aa, Artificial Sequence
  Description of Artificial Sequence: Synthetic polypeptide
  XENP019236 [CTLA-4]_H0.26_L0_Fab Heavy Chain
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7856 - protein, 118 aa, Artificial Sequence; identical to SEQ ID NO: 5094
  Description of Artificial Sequence: Synthetic polypeptide
  VH of XENP019236

SEQ ID NO: 7857 - protein, 5 aa, Artificial Sequence
  Description of Artificial Sequence: Synthetic peptide
  XENP019236 vhCDR1
SYGMH

SEQ ID NO: 7858 - protein, 17 aa, Artificial Sequence
  Description of Artificial Sequence: Synthetic peptide
  XENP019236 vhCDR2
FISYDGNNKYYADSVKG

SEQ ID NO: 7859 - protein, 9 aa, Artificial Sequence
  Description of Artificial Sequence: Synthetic peptide
  XENP019236 vhCDR3
TGWLGPFDY

SEQ ID NO: 7860 - protein, 215 aa, Artificial Sequence; identical to SEQ ID NO: 7600
  Description of Artificial Sequence: Synthetic polypeptide
  XENP019236 [CTLA-4]_H0.26_L0_Fab Light Chain

SEQ ID NO: 7861 - protein, 108 aa, Artificial Sequence; identical to SEQ ID NO: 3741
  Description of Artificial Sequence: Synthetic polypeptide
  VL of XENP019236

SEQ ID NO: 7862 - protein, 12 aa, Artificial Sequence
  Description of Artificial Sequence: Synthetic peptide
  XENP019236 vlCDR1
RASQSVGSSYLA

SEQ ID NO: 7863 - protein, 7 aa, Artificial Sequence
  Description of Artificial Sequence: Synthetic peptide
  XENP019236 vlCDR2
GAFSRAT

SEQ ID NO: 7864 - protein, 9 aa, Artificial Sequence
  Description of Artificial Sequence: Synthetic peptide
  XENP019236 vlCDR3
QQYGSSPWT

SEQ ID NO: 7865 - protein, 221 aa, Artificial Sequence
  Description of Artificial Sequence: Synthetic polypeptide
  XENP019237 [CTLA-4]_H0.27_L0_Fab Heavy Chain
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7866 - protein, 118 aa, Artificial Sequence; identical to SEQ ID NO: 5103
  Description of Artificial Sequence: Synthetic polypeptide
  VH of XENP019237

SEQ ID NO: 7867 - protein, 5 aa, Artificial Sequence
  Description of Artificial Sequence: Synthetic peptide
  XENP019237 vhCDR1
SYSMH

SEQ ID NO: 7868 - protein, 17 aa, Artificial Sequence
  Description of Artificial Sequence: Synthetic peptide
  XENP019237 vhCDR2
FISYDGNNKYYADSVKG

SEQ ID NO: 7869 - protein, 9 aa, Artificial Sequence
  Description of Artificial Sequence: Synthetic peptide
  XENP019237 vhCDR3
TGWLGPFDY

SEQ ID NO: 7870 - protein, 215 aa, Artificial Sequence; identical to SEQ ID NO: 7600
  Description of Artificial Sequence: Synthetic polypeptide
  XENP019237 [CTLA-4]_H0.27_L0_Fab Light Chain

SEQ ID NO: 7871 - protein, 108 aa, Artificial Sequence; identical to SEQ ID NO: 3741
  Description of Artificial Sequence: Synthetic polypeptide
  VL of XENP019237

SEQ ID NO: 7872 - protein, 12 aa, Artificial Sequence
  Description of Artificial Sequence: Synthetic peptide
  XENP019237 vlCDR1
RASQSVGSSYLA

SEQ ID NO: 7873 - protein, 7 aa, Artificial Sequence
  Description of Artificial Sequence: Synthetic peptide
  XENP019237 vlCDR2
GAFSRAT

SEQ ID NO: 7874 - protein, 9 aa, Artificial Sequence
  Description of Artificial Sequence: Synthetic peptide
  XENP019237 vlCDR3
QQYGSSPWT

SEQ ID NO: 7875 - protein, 221 aa, Artificial Sequence
  Description of Artificial Sequence: Synthetic polypeptide
  XENP019238 [CTLA-4]_H0.28_L0_Fab Heavy Chain
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7876 - protein, 118 aa, Artificial Sequence; identical to SEQ ID NO: 5112
  Description of Artificial Sequence: Synthetic polypeptide
  VH of XENP019238

SEQ ID NO: 7877 - protein, 5 aa, Artificial Sequence
  Description of Artificial Sequence: Synthetic peptide
  XENP019238 vhCDR1
SYVMH

SEQ ID NO: 7878 - protein, 17 aa, Artificial Sequence
  Description of Artificial Sequence: Synthetic peptide
  XENP019238 vhCDR2
FISYDGNNKYYADSVKG

SEQ ID NO: 7879 - protein, 9 aa, Artificial Sequence
  Description of Artificial Sequence: Synthetic peptide
  XENP019238 vhCDR3
TGWLGPFDY

SEQ ID NO: 7880 - protein, 215 aa, Artificial Sequence; identical to SEQ ID NO: 7600
  Description of Artificial Sequence: Synthetic polypeptide
  XENP019238 [CTLA-4]_H0.28_L0_Fab Light Chain

SEQ ID NO: 7881 - protein, 108 aa, Artificial Sequence; identical to SEQ ID NO: 3741
  Description of Artificial Sequence: Synthetic polypeptide
  VL of XENP019238

SEQ ID NO: 7882 - protein, 12 aa, Artificial Sequence
  Description of Artificial Sequence: Synthetic peptide
  XENP019238 vlCDR1
RASQSVGSSYLA

SEQ ID NO: 7883 - protein, 7 aa, Artificial Sequence
  Description of Artificial Sequence: Synthetic peptide
  XENP019238 vlCDR2
GAFSRAT

SEQ ID NO: 7884 - protein, 9 aa, Artificial Sequence
  Description of Artificial Sequence: Synthetic peptide
  XENP019238 vlCDR3
QQYGSSPWT

SEQ ID NO: 7885 - protein, 221 aa, Artificial Sequence
  Description of Artificial Sequence: Synthetic polypeptide
  XENP019239 [CTLA-4]_H0.29_L0_Fab Heavy Chain
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7886 - protein, 118 aa, Artificial Sequence; identical to SEQ ID NO: 5121
  Description of Artificial Sequence: Synthetic polypeptide
  VH of XENP019239

SEQ ID NO: 7887 - protein, 5 aa, Artificial Sequence
  Description of Artificial Sequence: Synthetic peptide
  XENP019239 vhCDR1
SYYMH

SEQ ID NO: 7888 - protein, 17 aa, Artificial Sequence
  Description of Artificial Sequence: Synthetic peptide
  XENP019239 vhCDR2
FISYDGNNKYYADSVKG

SEQ ID NO: 7889 - protein, 9 aa, Artificial Sequence
  Description of Artificial Sequence: Synthetic peptide
  XENP019239 vhCDR3
TGWLGPFDY

SEQ ID NO: 7890 - protein, 215 aa, Artificial Sequence; identical to SEQ ID NO: 7600
  Description of Artificial Sequence: Synthetic polypeptide
  XENP019239 [CTLA-4]_H0.29_L0_Fab Light Chain

SEQ ID NO: 7891 - protein, 108 aa, Artificial Sequence; identical to SEQ ID NO: 3741
  Description of Artificial Sequence: Synthetic polypeptide
  VL of XENP019239

SEQ ID NO: 7892 - protein, 12 aa, Artificial Sequence
  Description of Artificial Sequence: Synthetic peptide
  XENP019239 vlCDR1
RASQSVGSSYLA

SEQ ID NO: 7893 - protein, 7 aa, Artificial Sequence
  Description of Artificial Sequence: Synthetic peptide
  XENP019239 vlCDR2
GAFSRAT

SEQ ID NO: 7894 - protein, 9 aa, Artificial Sequence
  Description of Artificial Sequence: Synthetic peptide
  XENP019239 vlCDR3
QQYGSSPWT

SEQ ID NO: 7895 - protein, 221 aa, Artificial Sequence
  Description of Artificial Sequence: Synthetic polypeptide
  XENP019240 [CTLA-4]_H0.30_L0_Fab Heavy Chain
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7896 - protein, 118 aa, Artificial Sequence; identical to SEQ ID NO: 5130
  Description of Artificial Sequence: Synthetic polypeptide
  VH of XENP019240

SEQ ID NO: 7897 - protein, 5 aa, Artificial Sequence
  Description of Artificial Sequence: Synthetic peptide
  XENP019240 vhCDR1
SYTMD

SEQ ID NO: 7898 - protein, 17 aa, Artificial Sequence
  Description of Artificial Sequence: Synthetic peptide
  XENP019240 vhCDR2
FISYDGNNKYYADSVKG

SEQ ID NO: 7899 - protein, 9 aa, Artificial Sequence
  Description of Artificial Sequence: Synthetic peptide
  XENP019240 vhCDR3
TGWLGPFDY

SEQ ID NO: 7900 - protein, 215 aa, Artificial Sequence; identical to SEQ ID NO: 7600
  Description of Artificial Sequence: Synthetic polypeptide
  XENP019240 [CTLA-4]_H0.30_L0_Fab Light Chain

SEQ ID NO: 7901 - protein, 108 aa, Artificial Sequence; identical to SEQ ID NO: 3741
  Description of Artificial Sequence: Synthetic polypeptide
  VL of XENP019240

SEQ ID NO: 7902 - protein, 12 aa, Artificial Sequence
  Description of Artificial Sequence: Synthetic peptide
  XENP019240 vlCDR1
RASQSVGSSYLA

SEQ ID NO: 7903 - protein, 7 aa, Artificial Sequence
  Description of Artificial Sequence: Synthetic peptide
  XENP019240 vlCDR2
GAFSRAT

SEQ ID NO: 7904 - protein, 9 aa, Artificial Sequence
  Description of Artificial Sequence: Synthetic peptide
  XENP019240 vlCDR3
QQYGSSPWT

SEQ ID NO: 7905 - protein, 221 aa, Artificial Sequence
  Description of Artificial Sequence: Synthetic polypeptide
  XENP019241 [CTLA-4]_H0.31_L0_Fab Heavy Chain
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7906 - protein, 118 aa, Artificial Sequence; identical to SEQ ID NO: 5139
  Description of Artificial Sequence: Synthetic polypeptide
  VH of XENP019241

SEQ ID NO: 7907 - protein, 5 aa, Artificial Sequence
  Description of Artificial Sequence: Synthetic peptide
  XENP019241 vhCDR1
SYTMF

SEQ ID NO: 7908 - protein, 17 aa, Artificial Sequence
  Description of Artificial Sequence: Synthetic peptide
  XENP019241 vhCDR2
FISYDGNNKYYADSVKG

SEQ ID NO: 7909 - protein, 9 aa, Artificial Sequence
  Description of Artificial Sequence: Synthetic peptide
  XENP019241 vhCDR3
TGWLGPFDY

SEQ ID NO: 7910 - protein, 215 aa, Artificial Sequence; identical to SEQ ID NO: 7600
  Description of Artificial Sequence: Synthetic polypeptide
  XENP019241 [CTLA-4]_H0.31_L0_Fab Light Chain

SEQ ID NO: 7911 - protein, 108 aa, Artificial Sequence; identical to SEQ ID NO: 3741
  Description of Artificial Sequence: Synthetic polypeptide
  VL of XENP019241

SEQ ID NO: 7912 - protein, 12 aa, Artificial Sequence
  Description of Artificial Sequence: Synthetic peptide
  XENP019241 vlCDR1
RASQSVGSSYLA

SEQ ID NO: 7913 - protein, 7 aa, Artificial Sequence
  Description of Artificial Sequence: Synthetic peptide
  XENP019241 vlCDR2
GAFSRAT

SEQ ID NO: 7914 - protein, 9 aa, Artificial Sequence
  Description of Artificial Sequence: Synthetic peptide
  XENP019241 vlCDR3
QQYGSSPWT

SEQ ID NO: 7915 - protein, 221 aa, Artificial Sequence
  Description of Artificial Sequence: Synthetic polypeptide
  XENP019242 [CTLA-4]_H0.32_L0_Fab Heavy Chain
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7916 - protein, 118 aa, Artificial Sequence; identical to SEQ ID NO: 5148
  Description of Artificial Sequence: Synthetic polypeptide
  VH of XENP019242

SEQ ID NO: 7917 - protein, 5 aa, Artificial Sequence
  Description of Artificial Sequence: Synthetic peptide
  XENP019242 vhCDR1
SYTMN

SEQ ID NO: 7918 - protein, 17 aa, Artificial Sequence
  Description of Artificial Sequence: Synthetic peptide
  XENP019242 vhCDR2
FISYDGNNKYYADSVKG

SEQ ID NO: 7919 - protein, 9 aa, Artificial Sequence
  Description of Artificial Sequence: Synthetic peptide
  XENP019242 vhCDR3
TGWLGPFDY

SEQ ID NO: 7920 - protein, 215 aa, Artificial Sequence; identical to SEQ ID NO: 7600
  Description of Artificial Sequence: Synthetic polypeptide
  XENP019242 [CTLA-4]_H0.32_L0_Fab Light Chain

SEQ ID NO: 7921 - protein, 108 aa, Artificial Sequence; identical to SEQ ID NO: 3741
  Description of Artificial Sequence: Synthetic polypeptide
  VL of XENP019242

SEQ ID NO: 7922 - protein, 12 aa, Artificial Sequence
  Description of Artificial Sequence: Synthetic peptide
  XENP019242 vlCDR1
RASQSVGSSYLA

SEQ ID NO: 7923 - protein, 7 aa, Artificial Sequence
  Description of Artificial Sequence: Synthetic peptide
  XENP019242 vlCDR2
GAFSRAT

SEQ ID NO: 7924 - protein, 9 aa, Artificial Sequence
  Description of Artificial Sequence: Synthetic peptide
  XENP019242 vlCDR3
QQYGSSPWT

SEQ ID NO: 7925 - protein, 221 aa, Artificial Sequence
  Description of Artificial Sequence: Synthetic polypeptide
  XENP019243 [CTLA-4]_H0.33_L0_Fab Heavy Chain
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7926 - protein, 118 aa, Artificial Sequence; identical to SEQ ID NO: 5157
  Description of Artificial Sequence: Synthetic polypeptide
  VH of XENP019243

SEQ ID NO: 7927 - protein, 5 aa, Artificial Sequence
  Description of Artificial Sequence: Synthetic peptide
  XENP019243 vhCDR1
SYTMS

SEQ ID NO: 7928 - protein, 17 aa, Artificial Sequence
  Description of Artificial Sequence: Synthetic peptide
  XENP019243 vhCDR2
FISYDGNNKYYADSVKG

SEQ ID NO: 7929 - protein, 9 aa, Artificial Sequence
  Description of Artificial Sequence: Synthetic peptide
  XENP019243 vhCDR3
TGWLGPFDY

SEQ ID NO: 7930 - protein, 215 aa, Artificial Sequence; identical to SEQ ID NO: 7600
  Description of Artificial Sequence: Synthetic polypeptide
  XENP019243 [CTLA-4]_H0.33_L0_Fab Light Chain

SEQ ID NO: 7931 - protein, 108 aa, Artificial Sequence; identical to SEQ ID NO: 3741
  Description of Artificial Sequence: Synthetic polypeptide
  VL of XENP019243

SEQ ID NO: 7932 - protein, 12 aa, Artificial Sequence
  Description of Artificial Sequence: Synthetic peptide
  XENP019243 vlCDR1
RASQSVGSSYLA

SEQ ID NO: 7933 - protein, 7 aa, Artificial Sequence
  Description of Artificial Sequence: Synthetic peptide
  XENP019243 vlCDR2
GAFSRAT

SEQ ID NO: 7934 - protein, 9 aa, Artificial Sequence
  Description of Artificial Sequence: Synthetic peptide
  XENP019243 vlCDR3
QQYGSSPWT

SEQ ID NO: 7935 - protein, 221 aa, Artificial Sequence
  Description of Artificial Sequence: Synthetic polypeptide
  XENP019244 [CTLA-4]_H0.34_L0_Fab Heavy Chain
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7936 - protein, 118 aa, Artificial Sequence; identical to SEQ ID NO: 5166
  Description of Artificial Sequence: Synthetic polypeptide
  VH of XENP019244

SEQ ID NO: 7937 - protein, 5 aa, Artificial Sequence
  Description of Artificial Sequence: Synthetic peptide
  XENP019244 vhCDR1
SYTMY

SEQ ID NO: 7938 - protein, 17 aa, Artificial Sequence
  Description of Artificial Sequence: Synthetic peptide
  XENP019244 vhCDR2
FISYDGNNKYYADSVKG

SEQ ID NO: 7939 - protein, 9 aa, Artificial Sequence
  Description of Artificial Sequence: Synthetic peptide
  XENP019244 vhCDR3
TGWLGPFDY

SEQ ID NO: 7940 - protein, 215 aa, Artificial Sequence; identical to SEQ ID NO: 7600
  Description of Artificial Sequence: Synthetic polypeptide
  XENP019244 [CTLA-4]_H0.34_L0_Fab Light Chain

SEQ ID NO: 7941 - protein, 108 aa, Artificial Sequence; identical to SEQ ID NO: 3741
  Description of Artificial Sequence: Synthetic polypeptide
  VL of XENP019244

SEQ ID NO: 7942 - protein, 12 aa, Artificial Sequence
  Description of Artificial Sequence: Synthetic peptide
  XENP019244 vlCDR1
RASQSVGSSYLA

SEQ ID NO: 7943 - protein, 7 aa, Artificial Sequence
  Description of Artificial Sequence: Synthetic peptide
  XENP019244 vlCDR2
GAFSRAT

SEQ ID NO: 7944 - protein, 9 aa, Artificial Sequence
  Description of Artificial Sequence: Synthetic peptide
  XENP019244 vlCDR3
QQYGSSPWT

SEQ ID NO: 7945 - protein, 221 aa, Artificial Sequence
  Description of Artificial Sequence: Synthetic polypeptide
  XENP019245 [CTLA-4]_H0.35_L0_Fab Heavy Chain
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7946 - protein, 118 aa, Artificial Sequence; identical to SEQ ID NO: 5175
  Description of Artificial Sequence: Synthetic polypeptide
  VH of XENP019245

SEQ ID NO: 7947 - protein, 5 aa, Artificial Sequence
  Description of Artificial Sequence: Synthetic peptide
  XENP019245 vhCDR1
SYTMH

SEQ ID NO: 7948 - protein, 17 aa, Artificial Sequence
  Description of Artificial Sequence: Synthetic peptide
  XENP019245 vhCDR2
FISYDGNNKYYADSVKG

SEQ ID NO: 7949 - protein, 9 aa, Artificial Sequence
  Description of Artificial Sequence: Synthetic peptide
  XENP019245 vhCDR3
TGWLGPFDY

SEQ ID NO: 7950 - protein, 215 aa, Artificial Sequence; identical to SEQ ID NO: 7600
  Description of Artificial Sequence: Synthetic polypeptide
  XENP019245 [CTLA-4]_H0.35_L0_Fab Light Chain

SEQ ID NO: 7951 - protein, 108 aa, Artificial Sequence; identical to SEQ ID NO: 3741
  Description of Artificial Sequence: Synthetic polypeptide
  VL of XENP019245

SEQ ID NO: 7952 - protein, 12 aa, Artificial Sequence
  Description of Artificial Sequence: Synthetic peptide
  XENP019245 vlCDR1
RASQSVGSSYLA

SEQ ID NO: 7953 - protein, 7 aa, Artificial Sequence
  Description of Artificial Sequence: Synthetic peptide
  XENP019245 vlCDR2
GAFSRAT

SEQ ID NO: 7954 - protein, 9 aa, Artificial Sequence
  Description of Artificial Sequence: Synthetic peptide
  XENP019245 vlCDR3
QQYGSSPWT

SEQ ID NO: 7955 - protein, 221 aa, Artificial Sequence
  Description of Artificial Sequence: Synthetic polypeptide
  XENP019246 [CTLA-4]_H0.36_L0_Fab Heavy Chain
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7956 - protein, 118 aa, Artificial Sequence; identical to SEQ ID NO: 4707
  Description of Artificial Sequence: Synthetic polypeptide
  VH of XENP019246

SEQ ID NO: 7957 - protein, 5 aa, Artificial Sequence
  Description of Artificial Sequence: Synthetic peptide
  XENP019246 vhCDR1
SYTMH

SEQ ID NO: 7958 - protein, 17 aa, Artificial Sequence
  Description of Artificial Sequence: Synthetic peptide
  XENP019246 vhCDR2
FISYDGNNKYYADSVKG

SEQ ID NO: 7959 - protein, 9 aa, Artificial Sequence
  Description of Artificial Sequence: Synthetic peptide
  XENP019246 vhCDR3
TGWLGPFDY

SEQ ID NO: 7960 - protein, 215 aa, Artificial Sequence; identical to SEQ ID NO: 7600
  Description of Artificial Sequence: Synthetic polypeptide
  XENP019246 [CTLA-4]_H0.36_L0_Fab Light Chain

SEQ ID NO: 7961 - protein, 108 aa, Artificial Sequence; identical to SEQ ID NO: 3741
  Description of Artificial Sequence: Synthetic polypeptide
  VL of XENP019246

SEQ ID NO: 7962 - protein, 12 aa, Artificial Sequence
  Description of Artificial Sequence: Synthetic peptide
  XENP019246 vlCDR1
RASQSVGSSYLA

SEQ ID NO: 7963 - protein, 7 aa, Artificial Sequence
  Description of Artificial Sequence: Synthetic peptide
  XENP019246 vlCDR2
GAFSRAT

SEQ ID NO: 7964 - protein, 9 aa, Artificial Sequence
  Description of Artificial Sequence: Synthetic peptide
  XENP019246 vlCDR3
QQYGSSPWT

SEQ ID NO: 7965 - protein, 221 aa, Artificial Sequence
  Description of Artificial Sequence: Synthetic polypeptide
  XENP019247 [CTLA-4]_H0.37_L0_Fab Heavy Chain
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7966 - protein, 118 aa, Artificial Sequence; identical to SEQ ID NO: 4725
  Description of Artificial Sequence: Synthetic polypeptide
  VH of XENP019247

SEQ ID NO: 7967 - protein, 5 aa, Artificial Sequence
  Description of Artificial Sequence: Synthetic peptide
  XENP019247 vhCDR1
SYTMH

SEQ ID NO: 7968 - protein, 17 aa, Artificial Sequence
  Description of Artificial Sequence: Synthetic peptide
  XENP019247 vhCDR2
FISYDGNNKYYADSVKG

SEQ ID NO: 7969 - protein, 9 aa, Artificial Sequence
  Description of Artificial Sequence: Synthetic peptide
  XENP019247 vhCDR3
TGWLGPFDY

SEQ ID NO: 7970 - protein, 215 aa, Artificial Sequence; identical to SEQ ID NO: 7600
  Description of Artificial Sequence: Synthetic polypeptide
  XENP019247 [CTLA-4]_H0.37_L0_Fab Light Chain

SEQ ID NO: 7971 - protein, 108 aa, Artificial Sequence; identical to SEQ ID NO: 3741
  Description of Artificial Sequence: Synthetic polypeptide
  VL of XENP019247

SEQ ID NO: 7972 - protein, 12 aa, Artificial Sequence
  Description of Artificial Sequence: Synthetic peptide
  XENP019247 vlCDR1
RASQSVGSSYLA

SEQ ID NO: 7973 - protein, 7 aa, Artificial Sequence
  Description of Artificial Sequence: Synthetic peptide
  XENP019247 vlCDR2
GAFSRAT

SEQ ID NO: 7974 - protein, 9 aa, Artificial Sequence
  Description of Artificial Sequence: Synthetic peptide
  XENP019247 vlCDR3
QQYGSSPWT

SEQ ID NO: 7975 - protein, 221 aa, Artificial Sequence
  Description of Artificial Sequence: Synthetic polypeptide
  XENP019248 [CTLA-4]_H0.38_L0_Fab Heavy Chain
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7976 - protein, 118 aa, Artificial Sequence; identical to SEQ ID NO: 5202
  Description of Artificial Sequence: Synthetic polypeptide
  VH of XENP019248

SEQ ID NO: 7977 - protein, 5 aa, Artificial Sequence
  Description of Artificial Sequence: Synthetic peptide
  XENP019248 vhCDR1
SYTMH

SEQ ID NO: 7978 - protein, 17 aa, Artificial Sequence
  Description of Artificial Sequence: Synthetic peptide
  XENP019248 vhCDR2
FISYDGNNKYYADSVKG

SEQ ID NO: 7979 - protein, 9 aa, Artificial Sequence
  Description of Artificial Sequence: Synthetic peptide
  XENP019248 vhCDR3
TGWLGPFDY

SEQ ID NO: 7980 - protein, 215 aa, Artificial Sequence; identical to SEQ ID NO: 7600
  Description of Artificial Sequence: Synthetic polypeptide
  XENP019248 [CTLA-4]_H0.38_L0_Fab Light Chain

SEQ ID NO: 7981 - protein, 108 aa, Artificial Sequence; identical to SEQ ID NO: 3741
  Description of Artificial Sequence: Synthetic polypeptide
  VL of XENP019248

SEQ ID NO: 7982 - protein, 12 aa, Artificial Sequence
  Description of Artificial Sequence: Synthetic peptide
  XENP019248 vlCDR1
RASQSVGSSYLA

SEQ ID NO: 7983 - protein, 7 aa, Artificial Sequence
  Description of Artificial Sequence: Synthetic peptide
  XENP019248 vlCDR2
GAFSRAT

SEQ ID NO: 7984 - protein, 9 aa, Artificial Sequence
  Description of Artificial Sequence: Synthetic peptide
  XENP019248 vlCDR3
QQYGSSPWT

SEQ ID NO: 7985 - protein, 221 aa, Artificial Sequence
  Description of Artificial Sequence: Synthetic polypeptide
  XENP019249 [CTLA-4]_H0.39_L0_Fab Heavy Chain
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7986 - protein, 118 aa, Artificial Sequence; identical to SEQ ID NO: 5211
  Description of Artificial Sequence: Synthetic polypeptide
  VH of XENP019249

SEQ ID NO: 7987 - protein, 5 aa, Artificial Sequence
  Description of Artificial Sequence: Synthetic peptide
  XENP019249 vhCDR1
SYTMH

SEQ ID NO: 7988 - protein, 17 aa, Artificial Sequence
  Description of Artificial Sequence: Synthetic peptide
  XENP019249 vhCDR2
FISYDGNNKYYADSVKG

SEQ ID NO: 7989 - protein, 9 aa, Artificial Sequence
  Description of Artificial Sequence: Synthetic peptide
  XENP019249 vhCDR3
TGWLGPFDY

SEQ ID NO: 7990 - protein, 215 aa, Artificial Sequence; identical to SEQ ID NO: 7600
  Description of Artificial Sequence: Synthetic polypeptide
  XENP019249 [CTLA-4]_H0.39_L0_Fab Light Chain

SEQ ID NO: 7991 - protein, 108 aa, Artificial Sequence; identical to SEQ ID NO: 3741
  Description of Artificial Sequence: Synthetic polypeptide
  VL of XENP019249

SEQ ID NO: 7992 - protein, 12 aa, Artificial Sequence
  Description of Artificial Sequence: Synthetic peptide
  XENP019249 vlCDR1
RASQSVGSSYLA

SEQ ID NO: 7993 - protein, 7 aa, Artificial Sequence
  Description of Artificial Sequence: Synthetic peptide
  XENP019249 vlCDR2
GAFSRAT

SEQ ID NO: 7994 - protein, 9 aa, Artificial Sequence
  Description of Artificial Sequence: Synthetic peptide
  XENP019249 vlCDR3
QQYGSSPWT

SEQ ID NO: 7995 - protein, 221 aa, Artificial Sequence
  Description of Artificial Sequence: Synthetic polypeptide
  XENP019250 [CTLA-4]_H0.40_L0_Fab Heavy Chain
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7996 - protein, 118 aa, Artificial Sequence; identical to SEQ ID NO: 5220
  Description of Artificial Sequence: Synthetic polypeptide
  VH of XENP019250

SEQ ID NO: 7997 - protein, 5 aa, Artificial Sequence
  Description of Artificial Sequence: Synthetic peptide
  XENP019250 vhCDR1
SYTMH

SEQ ID NO: 7998 - protein, 17 aa, Artificial Sequence
  Description of Artificial Sequence: Synthetic peptide
  XENP019250 vhCDR2
FISYDGNNKYYADSVKG

SEQ ID NO: 7999 - protein, 9 aa, Artificial Sequence
  Description of Artificial Sequence: Synthetic peptide
  XENP019250 vhCDR3
TGWLGPFDY

SEQ ID NO: 8000 - protein, 215 aa, Artificial Sequence; identical to SEQ ID NO: 7600
  Description of Artificial Sequence: Synthetic polypeptide
  XENP019250 [CTLA-4]_H0.40_L0_Fab Light Chain

SEQ ID NO: 8001 - protein, 108 aa, Artificial Sequence; identical to SEQ ID NO: 3741
  Description of Artificial Sequence: Synthetic polypeptide
  VL of XENP019250

SEQ ID NO: 8002 - protein, 12 aa, Artificial Sequence
  Description of Artificial Sequence: Synthetic peptide
  XENP019250 vlCDR1
RASQSVGSSYLA

SEQ ID NO: 8003 - protein, 7 aa, Artificial Sequence
  Description of Artificial Sequence: Synthetic peptide
  XENP019250 vlCDR2
GAFSRAT

SEQ ID NO: 8004 - protein, 9 aa, Artificial Sequence
  Description of Artificial Sequence: Synthetic peptide
  XENP019250 vlCDR3
QQYGSSPWT

SEQ ID NO: 8005 - protein, 221 aa, Artificial Sequence
  Description of Artificial Sequence: Synthetic polypeptide
  XENP019251 [CTLA-4]_H0.41_L0_Fab Heavy Chain
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8006 - protein, 118 aa, Artificial Sequence; identical to SEQ ID NO: 5229
  Description of Artificial Sequence: Synthetic polypeptide
  VH of XENP019251

SEQ ID NO: 8007 - protein, 5 aa, Artificial Sequence
  Description of Artificial Sequence: Synthetic peptide
  XENP019251 vhCDR1
SYTMH

SEQ ID NO: 8008 - protein, 17 aa, Artificial Sequence
  Description of Artificial Sequence: Synthetic peptide
  XENP019251 vhCDR2
FISYDGNNKYYADSVKG

SEQ ID NO: 8009 - protein, 9 aa, Artificial Sequence
  Description of Artificial Sequence: Synthetic peptide
  XENP019251 vhCDR3
TGWLGPFDY

SEQ ID NO: 8010 - protein, 215 aa, Artificial Sequence; identical to SEQ ID NO: 7600
  Description of Artificial Sequence: Synthetic polypeptide
  XENP019251 [CTLA-4]_H0.41_L0_Fab Light Chain

SEQ ID NO: 8011 - protein, 108 aa, Artificial Sequence; identical to SEQ ID NO: 3741
  Description of Artificial Sequence: Synthetic polypeptide
  VL of XENP019251

SEQ ID NO: 8012 - protein, 12 aa, Artificial Sequence
  Description of Artificial Sequence: Synthetic peptide
  XENP019251 vlCDR1
RASQSVGSSYLA

SEQ ID NO: 8013 - protein, 7 aa, Artificial Sequence
  Description of Artificial Sequence: Synthetic peptide
  XENP019251 vlCDR2
GAFSRAT

SEQ ID NO: 8014 - protein, 9 aa, Artificial Sequence
  Description of Artificial Sequence: Synthetic peptide
  XENP019251 vlCDR3
QQYGSSPWT

SEQ ID NO: 8015 - protein, 221 aa, Artificial Sequence
  Description of Artificial Sequence: Synthetic polypeptide
  XENP019252 [CTLA-4]_H0.42_L0_Fab Heavy Chain
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8016 - protein, 118 aa, Artificial Sequence; identical to SEQ ID NO: 5238
  Description of Artificial Sequence: Synthetic polypeptide
  VH of XENP019252

SEQ ID NO: 8017 - protein, 5 aa, Artificial Sequence
  Description of Artificial Sequence: Synthetic peptide
  XENP019252 vhCDR1
SYTMH

SEQ ID NO: 8018 - protein, 17 aa, Artificial Sequence
  Description of Artificial Sequence: Synthetic peptide
  XENP019252 vhCDR2
AISYDGNNKYYADSVKG

SEQ ID NO: 8019 - protein, 9 aa, Artificial Sequence
  Description of Artificial Sequence: Synthetic peptide
  XENP019252 vhCDR3
TGWLGPFDY

SEQ ID NO: 8020 - protein, 215 aa, Artificial Sequence; identical to SEQ ID NO: 7600
  Description of Artificial Sequence: Synthetic polypeptide
  XENP019252 [CTLA-4]_H0.42_L0_Fab Light Chain

SEQ ID NO: 8021 - protein, 108 aa, Artificial Sequence; identical to SEQ ID NO: 3741
  Description of Artificial Sequence: Synthetic polypeptide
  VL of XENP019252

SEQ ID NO: 8022 - protein, 12 aa, Artificial Sequence
  Description of Artificial Sequence: Synthetic peptide
  XENP019252 vlCDR1
RASQSVGSSYLA

SEQ ID NO: 8023 - protein, 7 aa, Artificial Sequence
  Description of Artificial Sequence: Synthetic peptide
  XENP019252 vlCDR2
GAFSRAT

SEQ ID NO: 8024 - protein, 9 aa, Artificial Sequence
  Description of Artificial Sequence: Synthetic peptide
  XENP019252 vlCDR3
QQYGSSPWT

SEQ ID NO: 8025 - protein, 221 aa, Artificial Sequence
  Description of Artificial Sequence: Synthetic polypeptide
  XENP019253 [CTLA-4]_H0.43_L0_Fab Heavy Chain
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8026 - protein, 118 aa, Artificial Sequence; identical to SEQ ID NO: 5247
  Description of Artificial Sequence: Synthetic polypeptide
  VH of XENP019253

SEQ ID NO: 8027 - protein, 5 aa, Artificial Sequence
  Description of Artificial Sequence: Synthetic peptide
  XENP019253 vhCDR1
SYTMH

SEQ ID NO: 8028 - protein, 17 aa, Artificial Sequence
  Description of Artificial Sequence: Synthetic peptide
  XENP019253 vhCDR2
GISYDGNNKYYADSVKG

SEQ ID NO: 8029 - protein, 9 aa, Artificial Sequence
  Description of Artificial Sequence: Synthetic peptide
  XENP019253 vhCDR3
TGWLGPFDY

SEQ ID NO: 8030 - protein, 215 aa, Artificial Sequence; identical to SEQ ID NO: 7600
  Description of Artificial Sequence: Synthetic polypeptide
  XENP019253 [CTLA-4]_H0.43_L0_Fab Light Chain

SEQ ID NO: 8031 - protein, 108 aa, Artificial Sequence; identical to SEQ ID NO: 3741
  Description of Artificial Sequence: Synthetic polypeptide
  VL of XENP019253

SEQ ID NO: 8032 - protein, 12 aa, Artificial Sequence
  Description of Artificial Sequence: Synthetic peptide
  XENP019253 vlCDR1
RASQSVGSSYLA

SEQ ID NO: 8033 - protein, 7 aa, Artificial Sequence
  Description of Artificial Sequence: Synthetic peptide
  XENP019253 vlCDR2
GAFSRAT

SEQ ID NO: 8034 - protein, 9 aa, Artificial Sequence
  Description of Artificial Sequence: Synthetic peptide
  XENP019253 vlCDR3
QQYGSSPWT

SEQ ID NO: 8035 - protein, 221 aa, Artificial Sequence
  Description of Artificial Sequence: Synthetic polypeptide
  XENP019254 [CTLA-4]_H0.44_L0_Fab Heavy Chain
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8036 - protein, 118 aa, Artificial Sequence; identical to SEQ ID NO: 5256
  Description of Artificial Sequence: Synthetic polypeptide
  VH of XENP019254

SEQ ID NO: 8037 - protein, 5 aa, Artificial Sequence
  Description of Artificial Sequence: Synthetic peptide
  XENP019254 vhCDR1
SYTMH

SEQ ID NO: 8038 - protein, 17 aa, Artificial Sequence
  Description of Artificial Sequence: Synthetic peptide
  XENP019254 vhCDR2
LISYDGNNKYYADSVKG

SEQ ID NO: 8039 - protein, 9 aa, Artificial Sequence
  Description of Artificial Sequence: Synthetic peptide
  XENP019254 vhCDR3
TGWLGPFDY

SEQ ID NO: 8040 - protein, 215 aa, Artificial Sequence; identical to SEQ ID NO: 7600
  Description of Artificial Sequence: Synthetic polypeptide
  XENP019254 [CTLA-4]_H0.44_L0_Fab Light Chain

SEQ ID NO: 8041 - protein, 108 aa, Artificial Sequence; identical to SEQ ID NO: 3741
  Description of Artificial Sequence: Synthetic polypeptide
  VL of XENP019254

SEQ ID NO: 8042 - protein, 12 aa, Artificial Sequence
  Description of Artificial Sequence: Synthetic peptide
  XENP019254 vlCDR1
RASQSVGSSYLA

SEQ ID NO: 8043 - protein, 7 aa, Artificial Sequence
  Description of Artificial Sequence: Synthetic peptide
  XENP019254 vlCDR2
GAFSRAT

SEQ ID NO: 8044 - protein, 9 aa, Artificial Sequence
  Description of Artificial Sequence: Synthetic peptide
  XENP019254 vlCDR3
QQYGSSPWT

SEQ ID NO: 8045 - protein, 221 aa, Artificial Sequence
  Description of Artificial Sequence: Synthetic polypeptide
  XENP019255 [CTLA-4]_H0.45_L0_Fab Heavy Chain
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8046 - protein, 118 aa, Artificial Sequence; identical to SEQ ID NO: 5265
  Description of Artificial Sequence: Synthetic polypeptide
  VH of XENP019255

SEQ ID NO: 8047 - protein, 5 aa, Artificial Sequence
  Description of Artificial Sequence: Synthetic peptide
  XENP019255 vhCDR1
SYTMH

SEQ ID NO: 8048 - protein, 17 aa, Artificial Sequence
  Description of Artificial Sequence: Synthetic peptide
  XENP019255 vhCDR2
IISYDGNNKYYADSVKG

SEQ ID NO: 8049 - protein, 9 aa, Artificial Sequence
  Description of Artificial Sequence: Synthetic peptide
  XENP019255 vhCDR3
TGWLGPFDY

SEQ ID NO: 8050 - protein, 215 aa, Artificial Sequence; identical to SEQ ID NO: 7600
  Description of Artificial Sequence: Synthetic polypeptide
  XENP019255 [CTLA-4]_H0.45_L0_Fab Light Chain

SEQ ID NO: 8051 - protein, 108 aa, Artificial Sequence; identical to SEQ ID NO: 3741
  Description of Artificial Sequence: Synthetic polypeptide
  VL of XENP019255

SEQ ID NO: 8052 - protein, 12 aa, Artificial Sequence
  Description of Artificial Sequence: Synthetic peptide
  XENP019255 vlCDR1
RASQSVGSSYLA

SEQ ID NO: 8053 - protein, 7 aa, Artificial Sequence
  Description of Artificial Sequence: Synthetic peptide
  XENP019255 vlCDR2
GAFSRAT

SEQ ID NO: 8054 - protein, 9 aa, Artificial Sequence
  Description of Artificial Sequence: Synthetic peptide
  XENP019255 vlCDR3
QQYGSSPWT

SEQ ID NO: 8055 - protein, 221 aa, Artificial Sequence
  Description of Artificial Sequence: Synthetic polypeptide
  XENP019256 [CTLA-4]_H0.46_L0_Fab Heavy Chain
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8056 - protein, 118 aa, Artificial Sequence; identical to SEQ ID NO: 5274
  Description of Artificial Sequence: Synthetic polypeptide
  VH of XENP019256

SEQ ID NO: 8057 - protein, 5 aa, Artificial Sequence
  Description of Artificial Sequence: Synthetic peptide
  XENP019256 vhCDR1
SYTMH

SEQ ID NO: 8058 - protein, 17 aa, Artificial Sequence
  Description of Artificial Sequence: Synthetic peptide
  XENP019256 vhCDR2
RISYDGNNKYYADSVKG

SEQ ID NO: 8059 - protein, 9 aa, Artificial Sequence
  Description of Artificial Sequence: Synthetic peptide
  XENP019256 vhCDR3
TGWLGPFDY

SEQ ID NO: 8060 - protein, 215 aa, Artificial Sequence; identical to SEQ ID NO: 7600
  Description of Artificial Sequence: Synthetic polypeptide
  XENP019256 [CTLA-4]_H0.46_L0_Fab Light Chain

SEQ ID NO: 8061 - protein, 108 aa, Artificial Sequence; identical to SEQ ID NO: 3741
  Description of Artificial Sequence: Synthetic polypeptide
  VL of XENP019256

SEQ ID NO: 8062 - protein, 12 aa, Artificial Sequence
  Description of Artificial Sequence: Synthetic peptide
  XENP019256 vlCDR1
RASQSVGSSYLA

SEQ ID NO: 8063 - protein, 7 aa, Artificial Sequence
  Description of Artificial Sequence: Synthetic peptide
  XENP019256 vlCDR2
GAFSRAT

SEQ ID NO: 8064 - protein, 9 aa, Artificial Sequence
  Description of Artificial Sequence: Synthetic peptide
  XENP019256 vlCDR3
QQYGSSPWT

SEQ ID NO: 8065 - protein, 221 aa, Artificial Sequence
  Description of Artificial Sequence: Synthetic polypeptide
  XENP019257 [CTLA-4]_H0.47_L0_Fab Heavy Chain
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8066 - protein, 118 aa, Artificial Sequence; identical to SEQ ID NO: 5283
  Description of Artificial Sequence: Synthetic polypeptide
  VH of XENP019257

SEQ ID NO: 8067 - protein, 5 aa, Artificial Sequence
  Description of Artificial Sequence: Synthetic peptide
  XENP019257 vhCDR1
SYTMH

SEQ ID NO: 8068 - protein, 17 aa, Artificial Sequence
  Description of Artificial Sequence: Synthetic peptide
  XENP019257 vhCDR2
VISYDGNNKYYADSVKG

SEQ ID NO: 8069 - protein, 9 aa, Artificial Sequence
  Description of Artificial Sequence: Synthetic peptide
  XENP019257 vhCDR3
TGWLGPFDY

SEQ ID NO: 8070 - protein, 215 aa, Artificial Sequence; identical to SEQ ID NO: 7600
  Description of Artificial Sequence: Synthetic polypeptide
  XENP019257 [CTLA-4]_H0.47_L0_Fab Light Chain

SEQ ID NO: 8071 - protein, 108 aa, Artificial Sequence; identical to SEQ ID NO: 3741
  Description of Artificial Sequence: Synthetic polypeptide
  VL of XENP019257

SEQ ID NO: 8072 - protein, 12 aa, Artificial Sequence
  Description of Artificial Sequence: Synthetic peptide
  XENP019257 vlCDR1
RASQSVGSSYLA

SEQ ID NO: 8073 - protein, 7 aa, Artificial Sequence
  Description of Artificial Sequence: Synthetic peptide
  XENP019257 vlCDR2
GAFSRAT

SEQ ID NO: 8074 - protein, 9 aa, Artificial Sequence
  Description of Artificial Sequence: Synthetic peptide
  XENP019257 vlCDR3
QQYGSSPWT

SEQ ID NO: 8075 - protein, 221 aa, Artificial Sequence
  Description of Artificial Sequence: Synthetic polypeptide
  XENP019258 [CTLA-4]_H0.48_L0_Fab Heavy Chain
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8076 - protein, 118 aa, Artificial Sequence; identical to SEQ ID NO: 5292
  Description of Artificial Sequence: Synthetic polypeptide
  VH of XENP019258

SEQ ID NO: 8077 - protein, 5 aa, Artificial Sequence
  Description of Artificial Sequence: Synthetic peptide
  XENP019258 vhCDR1
SYTMH

SEQ ID NO: 8078 - protein, 17 aa, Artificial Sequence
  Description of Artificial Sequence: Synthetic peptide
  XENP019258 vhCDR2
YISYDGNNKYYADSVKG

SEQ ID NO: 8079 - protein, 9 aa, Artificial Sequence
  Description of Artificial Sequence: Synthetic peptide
  XENP019258 vhCDR3
TGWLGPFDY

SEQ ID NO: 8080 - protein, 215 aa, Artificial Sequence; identical to SEQ ID NO: 7600
  Description of Artificial Sequence: Synthetic polypeptide
  XENP019258 [CTLA-4]_H0.48_L0_Fab Light Chain

SEQ ID NO: 8081 - protein, 108 aa, Artificial Sequence; identical to SEQ ID NO: 3741
  Description of Artificial Sequence: Synthetic polypeptide
  VL of XENP019258

SEQ ID NO: 8082 - protein, 12 aa, Artificial Sequence
  Description of Artificial Sequence: Synthetic peptide
  XENP019258 vlCDR1
RASQSVGSSYLA

SEQ ID NO: 8083 - protein, 7 aa, Artificial Sequence
  Description of Artificial Sequence: Synthetic peptide
  XENP019258 vlCDR2
GAFSRAT

SEQ ID NO: 8084 - protein, 9 aa, Artificial Sequence
  Description of Artificial Sequence: Synthetic peptide
  XENP019258 vlCDR3
QQYGSSPWT

SEQ ID NO: 8085 - protein, 221 aa, Artificial Sequence
  Description of Artificial Sequence: Synthetic polypeptide
  XENP019259 [CTLA-4]_H0.49_L0_Fab Heavy Chain
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8086 - protein, 118 aa, Artificial Sequence; identical to SEQ ID NO: 5301
  Description of Artificial Sequence: Synthetic polypeptide
  VH of XENP019259

SEQ ID NO: 8087 - protein, 5 aa, Artificial Sequence
  Description of Artificial Sequence: Synthetic peptide
  XENP019259 vhCDR1
SYTMH

SEQ ID NO: 8088 - protein, 17 aa, Artificial Sequence
  Description of Artificial Sequence: Synthetic peptide
  XENP019259 vhCDR2
FESYDGNNKYYADSVKG

SEQ ID NO: 8089 - protein, 9 aa, Artificial Sequence
  Description of Artificial Sequence: Synthetic peptide
  XENP019259 vhCDR3
TGWLGPFDY

SEQ ID NO: 8090 - protein, 215 aa, Artificial Sequence; identical to SEQ ID NO: 7600
  Description of Artificial Sequence: Synthetic polypeptide
  XENP019259 [CTLA-4]_H0.49_L0_Fab Light Chain

SEQ ID NO: 8091 - protein, 108 aa, Artificial Sequence; identical to SEQ ID NO: 3741
  Description of Artificial Sequence: Synthetic polypeptide
  VL of XENP019259

SEQ ID NO: 8092 - protein, 12 aa, Artificial Sequence
  Description of Artificial Sequence: Synthetic peptide
  XENP019259 vlCDR1
RASQSVGSSYLA

SEQ ID NO: 8093 - protein, 7 aa, Artificial Sequence
  Description of Artificial Sequence: Synthetic peptide
  XENP019259 vlCDR2
GAFSRAT

SEQ ID NO: 8094 - protein, 9 aa, Artificial Sequence
  Description of Artificial Sequence: Synthetic peptide
  XENP019259 vlCDR3
QQYGSSPWT

SEQ ID NO: 8095 - protein, 221 aa, Artificial Sequence
  Description of Artificial Sequence: Synthetic polypeptide
  XENP019260 [CTLA-4]_H0.50_L0_Fab Heavy Chain
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8096 - protein, 118 aa, Artificial Sequence; identical to SEQ ID NO: 5310
  Description of Artificial Sequence: Synthetic polypeptide
  VH of XENP019260

SEQ ID NO: 8097 - protein, 5 aa, Artificial Sequence
  Description of Artificial Sequence: Synthetic peptide
  XENP019260 vhCDR1
SYTMH

SEQ ID NO: 8098 - protein, 17 aa, Artificial Sequence
  Description of Artificial Sequence: Synthetic peptide
  XENP019260 vhCDR2
FHSYDGNNKYYADSVKG

SEQ ID NO: 8099 - protein, 9 aa, Artificial Sequence
  Description of Artificial Sequence: Synthetic peptide
  XENP019260 vhCDR3
TGWLGPFDY

SEQ ID NO: 8100 - protein, 215 aa, Artificial Sequence; identical to SEQ ID NO: 7600
  Description of Artificial Sequence: Synthetic polypeptide
  XENP019260 [CTLA-4]_H0.50_L0_Fab Light Chain

SEQ ID NO: 8101 - protein, 108 aa, Artificial Sequence; identical to SEQ ID NO: 3741
  Description of Artificial Sequence: Synthetic polypeptide
  VL of XENP019260

SEQ ID NO: 8102 - protein, 12 aa, Artificial Sequence
  Description of Artificial Sequence: Synthetic peptide
  XENP019260 vlCDR1
RASQSVGSSYLA

SEQ ID NO: 8103 - protein, 7 aa, Artificial Sequence
  Description of Artificial Sequence: Synthetic peptide
  XENP019260 vlCDR2
GAFSRAT

SEQ ID NO: 8104 - protein, 9 aa, Artificial Sequence
  Description of Artificial Sequence: Synthetic peptide
  XENP019260 vlCDR3
QQYGSSPWT

SEQ ID NO: 8105 - protein, 221 aa, Artificial Sequence
  Description of Artificial Sequence: Synthetic polypeptide
  XENP019261 [CTLA-4]_H0.51_L0_Fab Heavy Chain
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8106 - protein, 118 aa, Artificial Sequence; identical to SEQ ID NO: 5319
  Description of Artificial Sequence: Synthetic polypeptide
  VH of XENP019261

SEQ ID NO: 8107 - protein, 5 aa, Artificial Sequence
  Description of Artificial Sequence: Synthetic peptide
  XENP019261 vhCDR1
SYTMH

SEQ ID NO: 8108 - protein, 17 aa, Artificial Sequence
  Description of Artificial Sequence: Synthetic peptide
  XENP019261 vhCDR2
FTSYDGNNKYYADSVKG

SEQ ID NO: 8109 - protein, 9 aa, Artificial Sequence
  Description of Artificial Sequence: Synthetic peptide
  XENP019261 vhCDR3
TGWLGPFDY

SEQ ID NO: 8110 - protein, 215 aa, Artificial Sequence; identical to SEQ ID NO: 7600
  Description of Artificial Sequence: Synthetic polypeptide
  XENP019261 [CTLA-4]_H0.51_L0_Fab Light Chain

SEQ ID NO: 8111 - protein, 108 aa, Artificial Sequence; identical to SEQ ID NO: 3741
  Description of Artificial Sequence: Synthetic polypeptide
  VL of XENP019261

SEQ ID NO: 8112 - protein, 12 aa, Artificial Sequence
  Description of Artificial Sequence: Synthetic peptide
  XENP019261 vlCDR1
RASQSVGSSYLA

SEQ ID NO: 8113 - protein, 7 aa, Artificial Sequence
  Description of Artificial Sequence: Synthetic peptide
  XENP019261 vlCDR2
GAFSRAT

SEQ ID NO: 8114 - protein, 9 aa, Artificial Sequence
  Description of Artificial Sequence: Synthetic peptide
  XENP019261 vlCDR3
QQYGSSPWT

SEQ ID NO: 8115 - protein, 221 aa, Artificial Sequence
  Description of Artificial Sequence: Synthetic polypeptide
  XENP019262 [CTLA-4]_H0.52_L0_Fab Heavy Chain
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8116 - protein, 118 aa, Artificial Sequence; identical to SEQ ID NO: 5328
  Description of Artificial Sequence: Synthetic polypeptide
  VH of XENP019262

SEQ ID NO: 8117 - protein, 5 aa, Artificial Sequence
  Description of Artificial Sequence: Synthetic peptide
  XENP019262 vhCDR1
SYTMH

SEQ ID NO: 8118 - protein, 17 aa, Artificial Sequence
  Description of Artificial Sequence: Synthetic peptide
  XENP019262 vhCDR2
FVSYDGNNKYYADSVKG

SEQ ID NO: 8119 - protein, 9 aa, Artificial Sequence
  Description of Artificial Sequence: Synthetic peptide
  XENP019262 vhCDR3
TGWLGPFDY

SEQ ID NO: 8120 - protein, 215 aa, Artificial Sequence; identical to SEQ ID NO: 7600
  Description of Artificial Sequence: Synthetic polypeptide
  XENP019262 [CTLA-4]_H0.52_L0_Fab Light Chain

SEQ ID NO: 8121 - protein, 108 aa, Artificial Sequence; identical to SEQ ID NO: 3741
  Description of Artificial Sequence: Synthetic polypeptide
  VL of XENP019262

SEQ ID NO: 8122 - protein, 12 aa, Artificial Sequence
  Description of Artificial Sequence: Synthetic peptide
  XENP019262 vlCDR1
RASQSVGSSYLA

SEQ ID NO: 8123 - protein, 7 aa, Artificial Sequence
  Description of Artificial Sequence: Synthetic peptide
  XENP019262 vlCDR2
GAFSRAT

SEQ ID NO: 8124 - protein, 9 aa, Artificial Sequence
  Description of Artificial Sequence: Synthetic peptide
  XENP019262 vlCDR3
QQYGSSPWT

SEQ ID NO: 8125 - protein, 221 aa, Artificial Sequence
  Description of Artificial Sequence: Synthetic polypeptide
  XENP019263 [CTLA-4]_H0.53_L0_Fab Heavy Chain
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8126 - protein, 118 aa, Artificial Sequence; identical to SEQ ID NO: 5337
  Description of Artificial Sequence: Synthetic polypeptide
  VH of XENP019263

SEQ ID NO: 8127 - protein, 5 aa, Artificial Sequence
  Description of Artificial Sequence: Synthetic peptide
  XENP019263 vhCDR1
SYTMH

SEQ ID NO: 8128 - protein, 17 aa, Artificial Sequence
  Description of Artificial Sequence: Synthetic peptide
  XENP019263 vhCDR2
FYSYDGNNKYYADSVKG

SEQ ID NO: 8129 - protein, 9 aa, Artificial Sequence
  Description of Artificial Sequence: Synthetic peptide
  XENP019263 vhCDR3
TGWLGPFDY

SEQ ID NO: 8130 - protein, 215 aa, Artificial Sequence; identical to SEQ ID NO: 7600
  Description of Artificial Sequence: Synthetic polypeptide
  XENP019263 [CTLA-4]_H0.53_L0_Fab Light Chain

SEQ ID NO: 8131 - protein, 108 aa, Artificial Sequence; identical to SEQ ID NO: 3741
  Description of Artificial Sequence: Synthetic polypeptide
  VL of XENP019263

SEQ ID NO: 8132 - protein, 12 aa, Artificial Sequence
  Description of Artificial Sequence: Synthetic peptide
  XENP019263 vlCDR1
RASQSVGSSYLA

SEQ ID NO: 8133 - protein, 7 aa, Artificial Sequence
  Description of Artificial Sequence: Synthetic peptide
  XENP019263 vlCDR2
GAFSRAT

SEQ ID NO: 8134 - protein, 9 aa, Artificial Sequence
  Description of Artificial Sequence: Synthetic peptide
  XENP019263 vlCDR3
QQYGSSPWT

SEQ ID NO: 8135 - protein, 221 aa, Artificial Sequence
  Description of Artificial Sequence: Synthetic polypeptide
  XENP019264 [CTLA-4]_H0.54_L0_Fab Heavy Chain
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8136 - protein, 118 aa, Artificial Sequence; identical to SEQ ID NO: 5346
  Description of Artificial Sequence: Synthetic polypeptide
  VH of XENP019264

SEQ ID NO: 8137 - protein, 5 aa, Artificial Sequence
  Description of Artificial Sequence: Synthetic peptide
  XENP019264 vhCDR1
SYTMH

SEQ ID NO: 8138 - protein, 17 aa, Artificial Sequence
  Description of Artificial Sequence: Synthetic peptide
  XENP019264 vhCDR2
FISGDGNNKYYADSVKG

SEQ ID NO: 8139 - protein, 9 aa, Artificial Sequence
  Description of Artificial Sequence: Synthetic peptide
  XENP019264 vhCDR3
TGWLGPFDY

SEQ ID NO: 8140 - protein, 215 aa, Artificial Sequence; identical to SEQ ID NO: 7600
  Description of Artificial Sequence: Synthetic polypeptide
  XENP019264 [CTLA-4]_H0.54_L0_Fab Light Chain

SEQ ID NO: 8141 - protein, 108 aa, Artificial Sequence; identical to SEQ ID NO: 3741
  Description of Artificial Sequence: Synthetic polypeptide
  VL of XENP019264

SEQ ID NO: 8142 - protein, 12 aa, Artificial Sequence
  Description of Artificial Sequence: Synthetic peptide
  XENP019264 vlCDR1
RASQSVGSSYLA

SEQ ID NO: 8143 - protein, 7 aa, Artificial Sequence
  Description of Artificial Sequence: Synthetic peptide
  XENP019264 vlCDR2
GAFSRAT

SEQ ID NO: 8144 - protein, 9 aa, Artificial Sequence
  Description of Artificial Sequence: Synthetic peptide
  XENP019264 vlCDR3
QQYGSSPWT

SEQ ID NO: 8145 - protein, 221 aa, Artificial Sequence
  Description of Artificial Sequence: Synthetic polypeptide
  XENP019265 [CTLA-4]_H0.55_L0_Fab Heavy Chain
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8146 - protein, 118 aa, Artificial Sequence; identical to SEQ ID NO: 5355
  Description of Artificial Sequence: Synthetic polypeptide
  VH of XENP019265

SEQ ID NO: 8147 - protein, 5 aa, Artificial Sequence
  Description of Artificial Sequence: Synthetic peptide
  XENP019265 vhCDR1
SYTMH

SEQ ID NO: 8148 - protein, 17 aa, Artificial Sequence
  Description of Artificial Sequence: Synthetic peptide
  XENP019265 vhCDR2
FISNDGNNKYYADSVKG

SEQ ID NO: 8149 - protein, 9 aa, Artificial Sequence
  Description of Artificial Sequence: Synthetic peptide
  XENP019265 vhCDR3
TGWLGPFDY

SEQ ID NO: 8150 - protein, 215 aa, Artificial Sequence; identical to SEQ ID NO: 7600
  Description of Artificial Sequence: Synthetic polypeptide
  XENP019265 [CTLA-4]_H0.55_L0_Fab Light Chain

SEQ ID NO: 8151 - protein, 108 aa, Artificial Sequence; identical to SEQ ID NO: 3741
  Description of Artificial Sequence: Synthetic polypeptide
  VL of XENP019265

SEQ ID NO: 8152 - protein, 12 aa, Artificial Sequence
  Description of Artificial Sequence: Synthetic peptide
  XENP019265 vlCDR1
RASQSVGSSYLA

SEQ ID NO: 8153 - protein, 7 aa, Artificial Sequence
  Description of Artificial Sequence: Synthetic peptide
  XENP019265 vlCDR2
GAFSRAT

SEQ ID NO: 8154 - protein, 9 aa, Artificial Sequence
  Description of Artificial Sequence: Synthetic peptide
  XENP019265 vlCDR3
QQYGSSPWT

SEQ ID NO: 8155 - protein, 221 aa, Artificial Sequence
  Description of Artificial Sequence: Synthetic polypeptide
  XENP019266 [CTLA-4]_H0.56_L0_Fab Heavy Chain
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8156 - protein, 118 aa, Artificial Sequence; identical to SEQ ID NO: 5364
  Description of Artificial Sequence: Synthetic polypeptide
  VH of XENP019266

SEQ ID NO: 8157 - protein, 5 aa, Artificial Sequence
  Description of Artificial Sequence: Synthetic peptide
  XENP019266 vhCDR1
SYTMH

SEQ ID NO: 8158 - protein, 17 aa, Artificial Sequence
  Description of Artificial Sequence: Synthetic peptide
  XENP019266 vhCDR2
FISSDGNNKYYADSVKG

SEQ ID NO: 8159 - protein, 9 aa, Artificial Sequence
  Description of Artificial Sequence: Synthetic peptide
  XENP019266 vhCDR3
TGWLGPFDY

SEQ ID NO: 8160 - protein, 215 aa, Artificial Sequence; identical to SEQ ID NO: 7600
  Description of Artificial Sequence: Synthetic polypeptide
  XENP019266 [CTLA-4]_H0.56_L0_Fab Light Chain

SEQ ID NO: 8161 - protein, 108 aa, Artificial Sequence; identical to SEQ ID NO: 3741
  Description of Artificial Sequence: Synthetic polypeptide
  VL of XENP019266

SEQ ID NO: 8162 - protein, 12 aa, Artificial Sequence
  Description of Artificial Sequence: Synthetic peptide
  XENP019266 vlCDR1
RASQSVGSSYLA

SEQ ID NO: 8163 - protein, 7 aa, Artificial Sequence
  Description of Artificial Sequence: Synthetic peptide
  XENP019266 vlCDR2
GAFSRAT

SEQ ID NO: 8164 - protein, 9 aa, Artificial Sequence
  Description of Artificial Sequence: Synthetic peptide
  XENP019266 vlCDR3
QQYGSSPWT

SEQ ID NO: 8165 - protein, 221 aa, Artificial Sequence
  Description of Artificial Sequence: Synthetic polypeptide
  XENP019267 [CTLA-4]_H0.57_L0_Fab Heavy Chain
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8166 - protein, 118 aa, Artificial Sequence; identical to SEQ ID NO: 5373
  Description of Artificial Sequence: Synthetic polypeptide
  VH of XENP019267

SEQ ID NO: 8167 - protein, 5 aa, Artificial Sequence
  Description of Artificial Sequence: Synthetic peptide
  XENP019267 vhCDR1
SYTMH

SEQ ID NO: 8168 - protein, 17 aa, Artificial Sequence
  Description of Artificial Sequence: Synthetic peptide
  XENP019267 vhCDR2
FISYNGNNKYYADSVKG

SEQ ID NO: 8169 - protein, 9 aa, Artificial Sequence
  Description of Artificial Sequence: Synthetic peptide
  XENP019267 vhCDR3
TGWLGPFDY

SEQ ID NO: 8170 - protein, 215 aa, Artificial Sequence; identical to SEQ ID NO: 7600
  Description of Artificial Sequence: Synthetic polypeptide
  XENP019267 [CTLA-4]_H0.57_L0_Fab Light Chain

SEQ ID NO: 8171 - protein, 108 aa, Artificial Sequence; identical to SEQ ID NO: 3741
  Description of Artificial Sequence: Synthetic polypeptide
  VL of XENP019267

SEQ ID NO: 8172 - protein, 12 aa, Artificial Sequence
  Description of Artificial Sequence: Synthetic peptide
  XENP019267 vlCDR1
RASQSVGSSYLA

SEQ ID NO: 8173 - protein, 7 aa, Artificial Sequence
  Description of Artificial Sequence: Synthetic peptide
  XENP019267 vlCDR2
GAFSRAT

SEQ ID NO: 8174 - protein, 9 aa, Artificial Sequence
  Description of Artificial Sequence: Synthetic peptide
  XENP019267 vlCDR3
QQYGSSPWT

SEQ ID NO: 8175 - protein, 221 aa, Artificial Sequence
  Description of Artificial Sequence: Synthetic polypeptide
  XENP019268 [CTLA-4]_H0.58_L0_Fab Heavy Chain
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8176 - protein, 118 aa, Artificial Sequence; identical to SEQ ID NO: 5382
  Description of Artificial Sequence: Synthetic polypeptide
  VH of XENP019268

SEQ ID NO: 8177 - protein, 5 aa, Artificial Sequence
  Description of Artificial Sequence: Synthetic peptide
  XENP019268 vhCDR1
SYTMH

SEQ ID NO: 8178 - protein, 17 aa, Artificial Sequence
  Description of Artificial Sequence: Synthetic peptide
  XENP019268 vhCDR2
FISYSGNNKYYADSVKG

SEQ ID NO: 8179 - protein, 9 aa, Artificial Sequence
  Description of Artificial Sequence: Synthetic peptide
  XENP019268 vhCDR3
TGWLGPFDY

SEQ ID NO: 8180 - protein, 215 aa, Artificial Sequence; identical to SEQ ID NO: 7600
  Description of Artificial Sequence: Synthetic polypeptide
  XENP019268 [CTLA-4]_H0.58_L0_Fab Light Chain

SEQ ID NO: 8181 - protein, 108 aa, Artificial Sequence; identical to SEQ ID NO: 3741
  Description of Artificial Sequence: Synthetic polypeptide
  VL of XENP019268

SEQ ID NO: 8182 - protein, 12 aa, Artificial Sequence
  Description of Artificial Sequence: Synthetic peptide
  XENP019268 vlCDR1
RASQSVGSSYLA

SEQ ID NO: 8183 - protein, 7 aa, Artificial Sequence
  Description of Artificial Sequence: Synthetic peptide
  XENP019268 vlCDR2
GAFSRAT

SEQ ID NO: 8184 - protein, 9 aa, Artificial Sequence
  Description of Artificial Sequence: Synthetic peptide
  XENP019268 vlCDR3
QQYGSSPWT

SEQ ID NO: 8185 - protein, 221 aa, Artificial Sequence
  Description of Artificial Sequence: Synthetic polypeptide
  XENP019269 [CTLA-4]_H0.59_L0_Fab Heavy Chain
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8186 - protein, 118 aa, Artificial Sequence; identical to SEQ ID NO: 5391
  Description of Artificial Sequence: Synthetic polypeptide
  VH of XENP019269

SEQ ID NO: 8187 - protein, 5 aa, Artificial Sequence
  Description of Artificial Sequence: Synthetic peptide
  XENP019269 vhCDR1
SYTMH

SEQ ID NO: 8188 - protein, 17 aa, Artificial Sequence
  Description of Artificial Sequence: Synthetic peptide
  XENP019269 vhCDR2
FISYEGNNKYYADSVKG

SEQ ID NO: 8189 - protein, 9 aa, Artificial Sequence
  Description of Artificial Sequence: Synthetic peptide
  XENP019269 vhCDR3
TGWLGPFDY

SEQ ID NO: 8190 - protein, 215 aa, Artificial Sequence; identical to SEQ ID NO: 7600
  Description of Artificial Sequence: Synthetic polypeptide
  XENP019269 [CTLA-4]_H0.59_L0_Fab Light Chain

SEQ ID NO: 8191 - protein, 108 aa, Artificial Sequence; identical to SEQ ID NO: 3741
  Description of Artificial Sequence: Synthetic polypeptide
  VL of XENP019269

SEQ ID NO: 8192 - protein, 12 aa, Artificial Sequence
  Description of Artificial Sequence: Synthetic peptide
  XENP019269 vlCDR1
RASQSVGSSYLA

SEQ ID NO: 8193 - protein, 7 aa, Artificial Sequence
  Description of Artificial Sequence: Synthetic peptide
  XENP019269 vlCDR2
GAFSRAT

SEQ ID NO: 8194 - protein, 9 aa, Artificial Sequence
  Description of Artificial Sequence: Synthetic peptide
  XENP019269 vlCDR3
QQYGSSPWT

SEQ ID NO: 8195 - protein, 221 aa, Artificial Sequence
  Description of Artificial Sequence: Synthetic polypeptide
  XENP019270 [CTLA-4]_H0.60_L0_Fab Heavy Chain
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8196 - protein, 118 aa, Artificial Sequence; identical to SEQ ID NO: 5400
  Description of Artificial Sequence: Synthetic polypeptide
  VH of XENP019270

SEQ ID NO: 8197 - protein, 5 aa, Artificial Sequence
  Description of Artificial Sequence: Synthetic peptide
  XENP019270 vhCDR1
SYTMH

SEQ ID NO: 8198 - protein, 17 aa, Artificial Sequence
  Description of Artificial Sequence: Synthetic peptide
  XENP019270 vhCDR2
FISYHGNNKYYADSVKG

SEQ ID NO: 8199 - protein, 9 aa, Artificial Sequence
  Description of Artificial Sequence: Synthetic peptide
  XENP019270 vhCDR3
TGWLGPFDY

SEQ ID NO: 8200 - protein, 215 aa, Artificial Sequence; identical to SEQ ID NO: 7600
  Description of Artificial Sequence: Synthetic polypeptide
  XENP019270 [CTLA-4]_H0.60_L0_Fab Light Chain

SEQ ID NO: 8201 - protein, 108 aa, Artificial Sequence; identical to SEQ ID NO: 3741
  Description of Artificial Sequence: Synthetic polypeptide
  VL of XENP019270

SEQ ID NO: 8202 - protein, 12 aa, Artificial Sequence
  Description of Artificial Sequence: Synthetic peptide
  XENP019270 vlCDR1
RASQSVGSSYLA

SEQ ID NO: 8203 - protein, 7 aa, Artificial Sequence
  Description of Artificial Sequence: Synthetic peptide
  XENP019270 vlCDR2
GAFSRAT

SEQ ID NO: 8204 - protein, 9 aa, Artificial Sequence
  Description of Artificial Sequence: Synthetic peptide
  XENP019270 vlCDR3
QQYGSSPWT

SEQ ID NO: 8205 - protein, 221 aa, Artificial Sequence
  Description of Artificial Sequence: Synthetic polypeptide
  XENP019271 [CTLA-4]_H0.61_L0_Fab Heavy Chain
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8206 - protein, 118 aa, Artificial Sequence; identical to SEQ ID NO: 5409
  Description of Artificial Sequence: Synthetic polypeptide
  VH of XENP019271

SEQ ID NO: 8207 - protein, 5 aa, Artificial Sequence
  Description of Artificial Sequence: Synthetic peptide
  XENP019271 vhCDR1
SYTMH

SEQ ID NO: 8208 - protein, 17 aa, Artificial Sequence
  Description of Artificial Sequence: Synthetic peptide
  XENP019271 vhCDR2
FISYKGNNKYYADSVKG

SEQ ID NO: 8209 - protein, 9 aa, Artificial Sequence
  Description of Artificial Sequence: Synthetic peptide
  XENP019271 vhCDR3
TGWLGPFDY

SEQ ID NO: 8210 - protein, 215 aa, Artificial Sequence; identical to SEQ ID NO: 7600
  Description of Artificial Sequence: Synthetic polypeptide
  XENP019271 [CTLA-4]_H0.61_L0_Fab Light Chain

SEQ ID NO: 8211 - protein, 108 aa, Artificial Sequence; identical to SEQ ID NO: 3741
  Description of Artificial Sequence: Synthetic polypeptide
  VL of XENP019271

SEQ ID NO: 8212 - protein, 12 aa, Artificial Sequence
  Description of Artificial Sequence: Synthetic peptide
  XENP019271 vlCDR1
RASQSVGSSYLA

SEQ ID NO: 8213 - protein, 7 aa, Artificial Sequence
  Description of Artificial Sequence: Synthetic peptide
  XENP019271 vlCDR2
GAFSRAT

SEQ ID NO: 8214 - protein, 9 aa, Artificial Sequence
  Description of Artificial Sequence: Synthetic peptide
  XENP019271 vlCDR3
QQYGSSPWT

SEQ ID NO: 8215 - protein, 221 aa, Artificial Sequence
  Description of Artificial Sequence: Synthetic polypeptide
  XENP019272 [CTLA-4]_H0.62_L0_Fab Heavy Chain
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8216 - protein, 118 aa, Artificial Sequence; identical to SEQ ID NO: 5418
  Description of Artificial Sequence: Synthetic polypeptide
  VH of XENP019272

SEQ ID NO: 8217 - protein, 5 aa, Artificial Sequence
  Description of Artificial Sequence: Synthetic peptide
  XENP019272 vhCDR1
SYTMH

SEQ ID NO: 8218 - protein, 17 aa, Artificial Sequence
  Description of Artificial Sequence: Synthetic peptide
  XENP019272 vhCDR2
FISYKGNNKYYADSVKG

SEQ ID NO: 8219 - protein, 9 aa, Artificial Sequence
  Description of Artificial Sequence: Synthetic peptide
  XENP019272 vhCDR3
TGWLGPFDY

SEQ ID NO: 8220 - protein, 215 aa, Artificial Sequence; identical to SEQ ID NO: 7600
  Description of Artificial Sequence: Synthetic polypeptide
  XENP019272 [CTLA-4]_H0.62_L0_Fab Light Chain

SEQ ID NO: 8221 - protein, 108 aa, Artificial Sequence; identical to SEQ ID NO: 3741
  Description of Artificial Sequence: Synthetic polypeptide
  VL of XENP019272

SEQ ID NO: 8222 - protein, 12 aa, Artificial Sequence
  Description of Artificial Sequence: Synthetic peptide
  XENP019272 vlCDR1
RASQSVGSSYLA

SEQ ID NO: 8223 - protein, 7 aa, Artificial Sequence
  Description of Artificial Sequence: Synthetic peptide
  XENP019272 vlCDR2
GAFSRAT

SEQ ID NO: 8224 - protein, 9 aa, Artificial Sequence
  Description of Artificial Sequence: Synthetic peptide
  XENP019272 vlCDR3
QQYGSSPWT

SEQ ID NO: 8225 - protein, 221 aa, Artificial Sequence
  Description of Artificial Sequence: Synthetic polypeptide
  XENP019273 [CTLA-4]_H0.63_L0_Fab Heavy Chain
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8226 - protein, 118 aa, Artificial Sequence; identical to SEQ ID NO: 5427
  Description of Artificial Sequence: Synthetic polypeptide
  VH of XENP019273

SEQ ID NO: 8227 - protein, 5 aa, Artificial Sequence
  Description of Artificial Sequence: Synthetic peptide
  XENP019273 vhCDR1
SYTMH

SEQ ID NO: 8228 - protein, 17 aa, Artificial Sequence
  Description of Artificial Sequence: Synthetic peptide
  XENP019273 vhCDR2
FISYQGNNKYYADSVKG

SEQ ID NO: 8229 - protein, 9 aa, Artificial Sequence
  Description of Artificial Sequence: Synthetic peptide
  XENP019273 vhCDR3
TGWLGPFDY

SEQ ID NO: 8230 - protein, 215 aa, Artificial Sequence; identical to SEQ ID NO: 7600
  Description of Artificial Sequence: Synthetic polypeptide
  XENP019273 [CTLA-4]_H0.63_L0_Fab Light Chain

SEQ ID NO: 8231 - protein, 108 aa, Artificial Sequence; identical to SEQ ID NO: 3741
  Description of Artificial Sequence: Synthetic polypeptide
  VL of XENP019273

SEQ ID NO: 8232 - protein, 12 aa, Artificial Sequence
  Description of Artificial Sequence: Synthetic peptide
  XENP019273 vlCDR1
RASQSVGSSYLA

SEQ ID NO: 8233 - protein, 7 aa, Artificial Sequence
  Description of Artificial Sequence: Synthetic peptide
  XENP019273 vlCDR2
GAFSRAT

SEQ ID NO: 8234 - protein, 9 aa, Artificial Sequence
  Description of Artificial Sequence: Synthetic peptide
  XENP019273 vlCDR3
QQYGSSPWT

SEQ ID NO: 8235 - protein, 221 aa, Artificial Sequence
  Description of Artificial Sequence: Synthetic polypeptide
  XENP019274 [CTLA-4]_H0.64_L0_Fab Heavy Chain
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8236 - protein, 118 aa, Artificial Sequence; identical to SEQ ID NO: 5436
  Description of Artificial Sequence: Synthetic polypeptide
  VH of XENP019274

SEQ ID NO: 8237 - protein, 5 aa, Artificial Sequence
  Description of Artificial Sequence: Synthetic peptide
  XENP019274 vhCDR1
SYTMH

SEQ ID NO: 8238 - protein, 17 aa, Artificial Sequence
  Description of Artificial Sequence: Synthetic peptide
  XENP019274 vhCDR2
FISYDKNNKYYADSVKG

SEQ ID NO: 8239 - protein, 9 aa, Artificial Sequence
  Description of Artificial Sequence: Synthetic peptide
  XENP019274 vhCDR3
TGWLGPFDY

SEQ ID NO: 8240 - protein, 215 aa, Artificial Sequence; identical to SEQ ID NO: 7600
  Description of Artificial Sequence: Synthetic polypeptide
  XENP019274 [CTLA-4]_H0.64_L0_Fab Light Chain

SEQ ID NO: 8241 - protein, 108 aa, Artificial Sequence; identical to SEQ ID NO: 3741
  Description of Artificial Sequence: Synthetic polypeptide
  VL of XENP019274

SEQ ID NO: 8242 - protein, 12 aa, Artificial Sequence
  Description of Artificial Sequence: Synthetic peptide
  XENP019274 vlCDR1
RASQSVGSSYLA

SEQ ID NO: 8243 - protein, 7 aa, Artificial Sequence
  Description of Artificial Sequence: Synthetic peptide
  XENP019274 vlCDR2
GAFSRAT

SEQ ID NO: 8244 - protein, 9 aa, Artificial Sequence
  Description of Artificial Sequence: Synthetic peptide
  XENP019274 vlCDR3
QQYGSSPWT

SEQ ID NO: 8245 - protein, 221 aa, Artificial Sequence
  Description of Artificial Sequence: Synthetic polypeptide
  XENP019275 [CTLA-4]_H0.65_L0_Fab Heavy Chain
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8246 - protein, 118 aa, Artificial Sequence; identical to SEQ ID NO: 5445
  Description of Artificial Sequence: Synthetic polypeptide
  VH of XENP019275

SEQ ID NO: 8247 - protein, 5 aa, Artificial Sequence
  Description of Artificial Sequence: Synthetic peptide
  XENP019275 vhCDR1
SYTMH

SEQ ID NO: 8248 - protein, 17 aa, Artificial Sequence
  Description of Artificial Sequence: Synthetic peptide
  XENP019275 vhCDR2
FISYDKNNKYYADSVKG

SEQ ID NO: 8249 - protein, 9 aa, Artificial Sequence
  Description of Artificial Sequence: Synthetic peptide
  XENP019275 vhCDR3
TGWLGPFDY

SEQ ID NO: 8250 - protein, 215 aa, Artificial Sequence; identical to SEQ ID NO: 7600
  Description of Artificial Sequence: Synthetic polypeptide
  XENP019275 [CTLA-4]_H0.65_L0_Fab Light Chain

SEQ ID NO: 8251 - protein, 108 aa, Artificial Sequence; identical to SEQ ID NO: 3741
  Description of Artificial Sequence: Synthetic polypeptide
  VL of XENP019275

SEQ ID NO: 8252 - protein, 12 aa, Artificial Sequence
  Description of Artificial Sequence: Synthetic peptide
  XENP019275 vlCDR1
RASQSVGSSYLA

SEQ ID NO: 8253 - protein, 7 aa, Artificial Sequence
  Description of Artificial Sequence: Synthetic peptide
  XENP019275 vlCDR2
GAFSRAT

SEQ ID NO: 8254 - protein, 9 aa, Artificial Sequence
  Description of Artificial Sequence: Synthetic peptide
  XENP019275 vlCDR3
QQYGSSPWT

SEQ ID NO: 8255 - protein, 221 aa, Artificial Sequence
  Description of Artificial Sequence: Synthetic polypeptide
  XENP019276 [CTLA-4]_H0.66_L0_Fab Heavy Chain
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8256 - protein, 118 aa, Artificial Sequence; identical to SEQ ID NO: 5454
  Description of Artificial Sequence: Synthetic polypeptide
  VH of XENP019276

SEQ ID NO: 8257 - protein, 5 aa, Artificial Sequence
  Description of Artificial Sequence: Synthetic peptide
  XENP019276 vhCDR1
SYTMH

SEQ ID NO: 8258 - protein, 17 aa, Artificial Sequence
  Description of Artificial Sequence: Synthetic peptide
  XENP019276 vhCDR2
FISYDGDNKYYADSVKG

SEQ ID NO: 8259 - protein, 9 aa, Artificial Sequence
  Description of Artificial Sequence: Synthetic peptide
  XENP019276 vhCDR3
TGWLGPFDY

SEQ ID NO: 8260 - protein, 215 aa, Artificial Sequence; identical to SEQ ID NO: 7600
  Description of Artificial Sequence: Synthetic polypeptide
  XENP019276 [CTLA-4]_H0.66_L0_Fab Light Chain

SEQ ID NO: 8261 - protein, 108 aa, Artificial Sequence; identical to SEQ ID NO: 3741
  Description of Artificial Sequence: Synthetic polypeptide
  VL of XENP019276

SEQ ID NO: 8262 - protein, 12 aa, Artificial Sequence
  Description of Artificial Sequence: Synthetic peptide
  XENP019276 vlCDR1
RASQSVGSSYLA

SEQ ID NO: 8263 - protein, 7 aa, Artificial Sequence
  Description of Artificial Sequence: Synthetic peptide
  XENP019276 vlCDR2
GAFSRAT

SEQ ID NO: 8264 - protein, 9 aa, Artificial Sequence
  Description of Artificial Sequence: Synthetic peptide
  XENP019276 vlCDR3
QQYGSSPWT

SEQ ID NO: 8265 - protein, 221 aa, Artificial Sequence
  Description of Artificial Sequence: Synthetic polypeptide
  XENP019277 [CTLA-4]_H0.67_L0_Fab Heavy Chain
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8266 - protein, 118 aa, Artificial Sequence; identical to SEQ ID NO: 5463
  Description of Artificial Sequence: Synthetic polypeptide
  VH of XENP019277

SEQ ID NO: 8267 - protein, 5 aa, Artificial Sequence
  Description of Artificial Sequence: Synthetic peptide
  XENP019277 vhCDR1
SYTMH

SEQ ID NO: 8268 - protein, 17 aa, Artificial Sequence
  Description of Artificial Sequence: Synthetic peptide
  XENP019277 vhCDR2
FISYDGGNKYYADSVKG

SEQ ID NO: 8269 - protein, 9 aa, Artificial Sequence
  Description of Artificial Sequence: Synthetic peptide
  XENP019277 vhCDR3
TGWLGPFDY

SEQ ID NO: 8270 - protein, 215 aa, Artificial Sequence; identical to SEQ ID NO: 7600
  Description of Artificial Sequence: Synthetic polypeptide
  XENP019277 [CTLA-4]_H0.67_L0_Fab Light Chain

SEQ ID NO: 8271 - protein, 108 aa, Artificial Sequence; identical to SEQ ID NO: 3741
  Description of Artificial Sequence: Synthetic polypeptide
  VL of XENP019277

SEQ ID NO: 8272 - protein, 12 aa, Artificial Sequence
  Description of Artificial Sequence: Synthetic peptide
  XENP019277 vlCDR1
RASQSVGSSYLA

SEQ ID NO: 8273 - protein, 7 aa, Artificial Sequence
  Description of Artificial Sequence: Synthetic peptide
  XENP019277 vlCDR2
GAFSRAT

SEQ ID NO: 8274 - protein, 9 aa, Artificial Sequence
  Description of Artificial Sequence: Synthetic peptide
  XENP019277 vlCDR3
QQYGSSPWT

SEQ ID NO: 8275 - protein, 221 aa, Artificial Sequence
  Description of Artificial Sequence: Synthetic polypeptide
  XENP019278 [CTLA-4]_H0.68_L0_Fab Heavy Chain
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8276 - protein, 118 aa, Artificial Sequence; identical to SEQ ID NO: 5472
  Description of Artificial Sequence: Synthetic polypeptide
  VH of XENP019278

SEQ ID NO: 8277 - protein, 5 aa, Artificial Sequence
  Description of Artificial Sequence: Synthetic peptide
  XENP019278 vhCDR1
SYTMH

SEQ ID NO: 8278 - protein, 17 aa, Artificial Sequence
  Description of Artificial Sequence: Synthetic peptide
  XENP019278 vhCDR2
FISYDGHNKYYADSVKG

SEQ ID NO: 8279 - protein, 9 aa, Artificial Sequence
  Description of Artificial Sequence: Synthetic peptide
  XENP019278 vhCDR3
TGWLGPFDY

SEQ ID NO: 8280 - protein, 215 aa, Artificial Sequence; identical to SEQ ID NO: 7600
  Description of Artificial Sequence: Synthetic polypeptide
  XENP019278 [CTLA-4]_H0.68_L0_Fab Light Chain

SEQ ID NO: 8281 - protein, 108 aa, Artificial Sequence; identical to SEQ ID NO: 3741
  Description of Artificial Sequence: Synthetic polypeptide
  VL of XENP019278

SEQ ID NO: 8282 - protein, 12 aa, Artificial Sequence
  Description of Artificial Sequence: Synthetic peptide
  XENP019278 vlCDR1
RASQSVGSSYLA

SEQ ID NO: 8283 - protein, 7 aa, Artificial Sequence
  Description of Artificial Sequence: Synthetic peptide
  XENP019278 vlCDR2
GAFSRAT

SEQ ID NO: 8284 - protein, 9 aa, Artificial Sequence
  Description of Artificial Sequence: Synthetic peptide
  XENP019278 vlCDR3
QQYGSSPWT

SEQ ID NO: 8285 - protein, 221 aa, Artificial Sequence
  Description of Artificial Sequence: Synthetic polypeptide
  XENP019279 [CTLA-4]_H0.69_L0_Fab Heavy Chain
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8286 - protein, 118 aa, Artificial Sequence; identical to SEQ ID NO: 5481
  Description of Artificial Sequence: Synthetic polypeptide
  VH of XENP019279

SEQ ID NO: 8287 - protein, 5 aa, Artificial Sequence
  Description of Artificial Sequence: Synthetic peptide
  XENP019279 vhCDR1
SYTMH

SEQ ID NO: 8288 - protein, 17 aa, Artificial Sequence
  Description of Artificial Sequence: Synthetic peptide
  XENP019279 vhCDR2
FISYDGQNKYYADSVKG

SEQ ID NO: 8289 - protein, 9 aa, Artificial Sequence
  Description of Artificial Sequence: Synthetic peptide
  XENP019279 vhCDR3
TGWLGPFDY

SEQ ID NO: 8290 - protein, 215 aa, Artificial Sequence; identical to SEQ ID NO: 7600
  Description of Artificial Sequence: Synthetic polypeptide
  XENP019279 [CTLA-4]_H0.69_L0_Fab Light Chain

SEQ ID NO: 8291 - protein, 108 aa, Artificial Sequence; identical to SEQ ID NO: 3741
  Description of Artificial Sequence: Synthetic polypeptide
  VL of XENP019279

SEQ ID NO: 8292 - protein, 12 aa, Artificial Sequence
  Description of Artificial Sequence: Synthetic peptide
  XENP019279 vlCDR1
RASQSVGSSYLA

SEQ ID NO: 8293 - protein, 7 aa, Artificial Sequence
  Description of Artificial Sequence: Synthetic peptide
  XENP019279 vlCDR2
GAFSRAT

SEQ ID NO: 8294 - protein, 9 aa, Artificial Sequence
  Description of Artificial Sequence: Synthetic peptide
  XENP019279 vlCDR3
QQYGSSPWT

SEQ ID NO: 8295 - protein, 221 aa, Artificial Sequence
  Description of Artificial Sequence: Synthetic polypeptide
  XENP019280 [CTLA-4]_H0.70_L0_Fab Heavy Chain
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8296 - protein, 118 aa, Artificial Sequence; identical to SEQ ID NO: 5490
  Description of Artificial Sequence: Synthetic polypeptide
  VH of XENP019280

SEQ ID NO: 8297 - protein, 5 aa, Artificial Sequence
  Description of Artificial Sequence: Synthetic peptide
  XENP019280 vhCDR1
SYTMH

SEQ ID NO: 8298 - protein, 17 aa, Artificial Sequence
  Description of Artificial Sequence: Synthetic peptide
  XENP019280 vhCDR2
FISYDGSNKYYADSVKG

SEQ ID NO: 8299 - protein, 9 aa, Artificial Sequence
  Description of Artificial Sequence: Synthetic peptide
  XENP019280 vhCDR3
TGWLGPFDY

SEQ ID NO: 8300 - protein, 215 aa, Artificial Sequence; identical to SEQ ID NO: 7600
  Description of Artificial Sequence: Synthetic polypeptide
  XENP019280 [CTLA-4]_H0.70_L0_Fab Light Chain

SEQ ID NO: 8301 - protein, 108 aa, Artificial Sequence; identical to SEQ ID NO: 3741
  Description of Artificial Sequence: Synthetic polypeptide
  VL of XENP019280

SEQ ID NO: 8302 - protein, 12 aa, Artificial Sequence
  Description of Artificial Sequence: Synthetic peptide
  XENP019280 vlCDR1
RASQSVGSSYLA

SEQ ID NO: 8303 - protein, 7 aa, Artificial Sequence
  Description of Artificial Sequence: Synthetic peptide
  XENP019280 vlCDR2
GAFSRAT

SEQ ID NO: 8304 - protein, 9 aa, Artificial Sequence
  Description of Artificial Sequence: Synthetic peptide
  XENP019280 vlCDR3
QQYGSSPWT

SEQ ID NO: 8305 - protein, 221 aa, Artificial Sequence
  Description of Artificial Sequence: Synthetic polypeptide
  XENP019281 [CTLA-4]_H0.71_L0_Fab Heavy Chain
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8306 - protein, 118 aa, Artificial Sequence; identical to SEQ ID NO: 5499
  Description of Artificial Sequence: Synthetic polypeptide
  VH of XENP019281

SEQ ID NO: 8307 - protein, 5 aa, Artificial Sequence
  Description of Artificial Sequence: Synthetic peptide
  XENP019281 vhCDR1
SYTMH

SEQ ID NO: 8308 - protein, 17 aa, Artificial Sequence
  Description of Artificial Sequence: Synthetic peptide
  XENP019281 vhCDR2
FISYDGNDKYYADSVKG

SEQ ID NO: 8309 - protein, 9 aa, Artificial Sequence
  Description of Artificial Sequence: Synthetic peptide
  XENP019281 vhCDR3
TGWLGPFDY

SEQ ID NO: 8310 - protein, 215 aa, Artificial Sequence; identical to SEQ ID NO: 7600
  Description of Artificial Sequence: Synthetic polypeptide
  XENP019281 [CTLA-4]_H0.71_L0_Fab Light Chain

SEQ ID NO: 8311 - protein, 108 aa, Artificial Sequence; identical to SEQ ID NO: 3741
  Description of Artificial Sequence: Synthetic polypeptide
  VL of XENP019281

SEQ ID NO: 8312 - protein, 12 aa, Artificial Sequence
  Description of Artificial Sequence: Synthetic peptide
  XENP019281 vlCDR1
RASQSVGSSYLA

SEQ ID NO: 8313 - protein, 7 aa, Artificial Sequence
  Description of Artificial Sequence: Synthetic peptide
  XENP019281 vlCDR2
GAFSRAT

SEQ ID NO: 8314 - protein, 9 aa, Artificial Sequence
  Description of Artificial Sequence: Synthetic peptide
  XENP019281 vlCDR3
QQYGSSPWT

SEQ ID NO: 8315 - protein, 221 aa, Artificial Sequence
  Description of Artificial Sequence: Synthetic polypeptide
  XENP019282 [CTLA-4]_H0.72_L0_Fab Heavy Chain
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8316 - protein, 118 aa, Artificial Sequence; identical to SEQ ID NO: 5508
  Description of Artificial Sequence: Synthetic polypeptide
  VH of XENP019282

SEQ ID NO: 8317 - protein, 5 aa, Artificial Sequence
  Description of Artificial Sequence: Synthetic peptide
  XENP019282 vhCDR1
SYTMH

SEQ ID NO: 8318 - protein, 17 aa, Artificial Sequence
  Description of Artificial Sequence: Synthetic peptide
  XENP019282 vhCDR2
FISYDGNEKYYADSVKG

SEQ ID NO: 8319 - protein, 9 aa, Artificial Sequence
  Description of Artificial Sequence: Synthetic peptide
  XENP019282 vhCDR3
TGWLGPFDY

SEQ ID NO: 8320 - protein, 215 aa, Artificial Sequence; identical to SEQ ID NO: 7600
  Description of Artificial Sequence: Synthetic polypeptide
  XENP019282 [CTLA-4]_H0.72_L0_Fab Light Chain

SEQ ID NO: 8321 - protein, 108 aa, Artificial Sequence; identical to SEQ ID NO: 3741
  Description of Artificial Sequence: Synthetic polypeptide
  VL of XENP019282

SEQ ID NO: 8322 - protein, 12 aa, Artificial Sequence
  Description of Artificial Sequence: Synthetic peptide
  XENP019282 vlCDR1
RASQSVGSSYLA

SEQ ID NO: 8323 - protein, 7 aa, Artificial Sequence
  Description of Artificial Sequence: Synthetic peptide
  XENP019282 vlCDR2
GAFSRAT

SEQ ID NO: 8324 - protein, 9 aa, Artificial Sequence
  Description of Artificial Sequence: Synthetic peptide
  XENP019282 vlCDR3
QQYGSSPWT

SEQ ID NO: 8325 - protein, 221 aa, Artificial Sequence
  Description of Artificial Sequence: Synthetic polypeptide
  XENP019283 [CTLA-4]_H0.73_L0_Fab Heavy Chain
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8326 - protein, 118 aa, Artificial Sequence; identical to SEQ ID NO: 5517
  Description of Artificial Sequence: Synthetic polypeptide
  VH of XENP019283

SEQ ID NO: 8327 - protein, 5 aa, Artificial Sequence
  Description of Artificial Sequence: Synthetic peptide
  XENP019283 vhCDR1
SYTMH

SEQ ID NO: 8328 - protein, 17 aa, Artificial Sequence
  Description of Artificial Sequence: Synthetic peptide
  XENP019283 vhCDR2
FISYDGNHKYYADSVKG

SEQ ID NO: 8329 - protein, 9 aa, Artificial Sequence
  Description of Artificial Sequence: Synthetic peptide
  XENP019283 vhCDR3
TGWLGPFDY

SEQ ID NO: 8330 - protein, 215 aa, Artificial Sequence; identical to SEQ ID NO: 7600
  Description of Artificial Sequence: Synthetic polypeptide
  XENP019283 [CTLA-4]_H0.73_L0_Fab Light Chain

SEQ ID NO: 8331 - protein, 108 aa, Artificial Sequence; identical to SEQ ID NO: 3741
  Description of Artificial Sequence: Synthetic polypeptide
  VL of XENP019283

SEQ ID NO: 8332 - protein, 12 aa, Artificial Sequence
  Description of Artificial Sequence: Synthetic peptide
  XENP019283 vlCDR1
RASQSVGSSYLA

SEQ ID NO: 8333 - protein, 7 aa, Artificial Sequence
  Description of Artificial Sequence: Synthetic peptide
  XENP019283 vlCDR2
GAFSRAT

SEQ ID NO: 8334 - protein, 9 aa, Artificial Sequence
  Description of Artificial Sequence: Synthetic peptide
  XENP019283 vlCDR3
QQYGSSPWT

SEQ ID NO: 8335 - protein, 221 aa, Artificial Sequence
  Description of Artificial Sequence: Synthetic polypeptide
  XENP019284 [CTLA-4]_H0.74_L0_Fab Heavy Chain
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8336 - protein, 118 aa, Artificial Sequence; identical to SEQ ID NO: 5526
  Description of Artificial Sequence: Synthetic polypeptide
  VH of XENP019284

SEQ ID NO: 8337 - protein, 5 aa, Artificial Sequence
  Description of Artificial Sequence: Synthetic peptide
  XENP019284 vhCDR1
SYTMH

SEQ ID NO: 8338 - protein, 17 aa, Artificial Sequence
  Description of Artificial Sequence: Synthetic peptide
  XENP019284 vhCDR2
FISYDGNSKYYADSVKG

SEQ ID NO: 8339 - protein, 9 aa, Artificial Sequence
  Description of Artificial Sequence: Synthetic peptide
  XENP019284 vhCDR3
TGWLGPFDY

SEQ ID NO: 8340 - protein, 215 aa, Artificial Sequence; identical to SEQ ID NO: 7600
  Description of Artificial Sequence: Synthetic polypeptide
  XENP019284 [CTLA-4]_H0.74_L0_Fab Light Chain

SEQ ID NO: 8341 - protein, 108 aa, Artificial Sequence; identical to SEQ ID NO: 3741
  Description of Artificial Sequence: Synthetic polypeptide
  VL of XENP019284

SEQ ID NO: 8342 - protein, 12 aa, Artificial Sequence
  Description of Artificial Sequence: Synthetic peptide
  XENP019284 vlCDR1
RASQSVGSSYLA

SEQ ID NO: 8343 - protein, 7 aa, Artificial Sequence
  Description of Artificial Sequence: Synthetic peptide
  XENP019284 vlCDR2
GAFSRAT

SEQ ID NO: 8344 - protein, 9 aa, Artificial Sequence
  Description of Artificial Sequence: Synthetic peptide
  XENP019284 vlCDR3
QQYGSSPWT

SEQ ID NO: 8345 - protein, 221 aa, Artificial Sequence
  Description of Artificial Sequence: Synthetic polypeptide
  XENP019285 [CTLA-4]_H0.75_L0_Fab Heavy Chain
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8346 - protein, 118 aa, Artificial Sequence; identical to SEQ ID NO: 5535
  Description of Artificial Sequence: Synthetic polypeptide
  VH of XENP019285

SEQ ID NO: 8347 - protein, 5 aa, Artificial Sequence
  Description of Artificial Sequence: Synthetic peptide
  XENP019285 vhCDR1
SYTMH

SEQ ID NO: 8348 - protein, 17 aa, Artificial Sequence
  Description of Artificial Sequence: Synthetic peptide
  XENP019285 vhCDR2
FISYDGNTKYYADSVKG

SEQ ID NO: 8349 - protein, 9 aa, Artificial Sequence
  Description of Artificial Sequence: Synthetic peptide
  XENP019285 vhCDR3
TGWLGPFDY

SEQ ID NO: 8350 - protein, 215 aa, Artificial Sequence; identical to SEQ ID NO: 7600
  Description of Artificial Sequence: Synthetic polypeptide
  XENP019285 [CTLA-4]_H0.75_L0_Fab Light Chain

SEQ ID NO: 8351 - protein, 108 aa, Artificial Sequence; identical to SEQ ID NO: 3741
  Description of Artificial Sequence: Synthetic polypeptide
  VL of XENP019285

SEQ ID NO: 8352 - protein, 12 aa, Artificial Sequence
  Description of Artificial Sequence: Synthetic peptide
  XENP019285 vlCDR1
RASQSVGSSYLA

SEQ ID NO: 8353 - protein, 7 aa, Artificial Sequence
  Description of Artificial Sequence: Synthetic peptide
  XENP019285 vlCDR2
GAFSRAT

SEQ ID NO: 8354 - protein, 9 aa, Artificial Sequence
  Description of Artificial Sequence: Synthetic peptide
  XENP019285 vlCDR3
QQYGSSPWT

SEQ ID NO: 8355 - protein, 221 aa, Artificial Sequence
  Description of Artificial Sequence: Synthetic polypeptide
  XENP019286 [CTLA-4]_H0.76_L0_Fab Heavy Chain
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8356 - protein, 118 aa, Artificial Sequence; identical to SEQ ID NO: 5544
  Description of Artificial Sequence: Synthetic polypeptide
  VH of XENP019286

SEQ ID NO: 8357 - protein, 5 aa, Artificial Sequence
  Description of Artificial Sequence: Synthetic peptide
  XENP019286 vhCDR1
SYTMH

SEQ ID NO: 8358 - protein, 17 aa, Artificial Sequence
  Description of Artificial Sequence: Synthetic peptide
  XENP019286 vhCDR2
FISYDGNQKYYADSVKG

SEQ ID NO: 8359 - protein, 9 aa, Artificial Sequence
  Description of Artificial Sequence: Synthetic peptide
  XENP019286 vhCDR3
TGWLGPFDY

SEQ ID NO: 8360 - protein, 215 aa, Artificial Sequence; identical to SEQ ID NO: 7600
  Description of Artificial Sequence: Synthetic polypeptide
  XENP019286 [CTLA-4]_H0.76_L0_Fab Light Chain

SEQ ID NO: 8361 - protein, 108 aa, Artificial Sequence; identical to SEQ ID NO: 3741
  Description of Artificial Sequence: Synthetic polypeptide
  VL of XENP019286

SEQ ID NO: 8362 - protein, 12 aa, Artificial Sequence
  Description of Artificial Sequence: Synthetic peptide
  XENP019286 vlCDR1
RASQSVGSSYLA

SEQ ID NO: 8363 - protein, 7 aa, Artificial Sequence
  Description of Artificial Sequence: Synthetic peptide
  XENP019286 vlCDR2
GAFSRAT

SEQ ID NO: 8364 - protein, 9 aa, Artificial Sequence
  Description of Artificial Sequence: Synthetic peptide
  XENP019286 vlCDR3
QQYGSSPWT

SEQ ID NO: 8365 - protein, 221 aa, Artificial Sequence
  Description of Artificial Sequence: Synthetic polypeptide
  XENP019287 [CTLA-4]_H0.77_L0_Fab Heavy Chain
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8366 - protein, 118 aa, Artificial Sequence; identical to SEQ ID NO: 5553
  Description of Artificial Sequence: Synthetic polypeptide
  VH of XENP019287

SEQ ID NO: 8367 - protein, 5 aa, Artificial Sequence
  Description of Artificial Sequence: Synthetic peptide
  XENP019287 vhCDR1
SYTMH

SEQ ID NO: 8368 - protein, 17 aa, Artificial Sequence
  Description of Artificial Sequence: Synthetic peptide
  XENP019287 vhCDR2
FISYDGNNIYYADSVKG

SEQ ID NO: 8369 - protein, 9 aa, Artificial Sequence
  Description of Artificial Sequence: Synthetic peptide
  XENP019287 vhCDR3
TGWLGPFDY

SEQ ID NO: 8370 - protein, 215 aa, Artificial Sequence; identical to SEQ ID NO: 7600
  Description of Artificial Sequence: Synthetic polypeptide
  XENP019287 [CTLA-4]_H0.77_L0_Fab Light Chain

SEQ ID NO: 8371 - protein, 108 aa, Artificial Sequence; identical to SEQ ID NO: 3741
  Description of Artificial Sequence: Synthetic polypeptide
  VL of XENP019287

SEQ ID NO: 8372 - protein, 12 aa, Artificial Sequence
  Description of Artificial Sequence: Synthetic peptide
  XENP019287 vlCDR1
RASQSVGSSYLA

SEQ ID NO: 8373 - protein, 7 aa, Artificial Sequence
  Description of Artificial Sequence: Synthetic peptide
  XENP019287 vlCDR2
GAFSRAT

SEQ ID NO: 8374 - protein, 9 aa, Artificial Sequence
  Description of Artificial Sequence: Synthetic peptide
  XENP019287 vlCDR3
QQYGSSPWT

SEQ ID NO: 8375 - protein, 221 aa, Artificial Sequence
  Description of Artificial Sequence: Synthetic polypeptide
  XENP019288 [CTLA-4]_H0.78_L0_Fab Heavy Chain
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8376 - protein, 118 aa, Artificial Sequence; identical to SEQ ID NO: 5562
  Description of Artificial Sequence: Synthetic polypeptide
  VH of XENP019288

SEQ ID NO: 8377 - protein, 5 aa, Artificial Sequence
  Description of Artificial Sequence: Synthetic peptide
  XENP019288 vhCDR1
SYTMH

SEQ ID NO: 8378 - protein, 17 aa, Artificial Sequence
  Description of Artificial Sequence: Synthetic peptide
  XENP019288 vhCDR2
FISYDGNNTYYADSVKG

SEQ ID NO: 8379 - protein, 9 aa, Artificial Sequence
  Description of Artificial Sequence: Synthetic peptide
  XENP019288 vhCDR3
TGWLGPFDY

SEQ ID NO: 8380 - protein, 215 aa, Artificial Sequence; identical to SEQ ID NO: 7600
  Description of Artificial Sequence: Synthetic polypeptide
  XENP019288 [CTLA-4]_H0.78_L0_Fab Light Chain

SEQ ID NO: 8381 - protein, 108 aa, Artificial Sequence; identical to SEQ ID NO: 3741
  Description of Artificial Sequence: Synthetic polypeptide
  VL of XENP019288

SEQ ID NO: 8382 - protein, 12 aa, Artificial Sequence
  Description of Artificial Sequence: Synthetic peptide
  XENP019288 vlCDR1
RASQSVGSSYLA

SEQ ID NO: 8383 - protein, 7 aa, Artificial Sequence
  Description of Artificial Sequence: Synthetic peptide
  XENP019288 vlCDR2
GAFSRAT

SEQ ID NO: 8384 - protein, 9 aa, Artificial Sequence
  Description of Artificial Sequence: Synthetic peptide
  XENP019288 vlCDR3
QQYGSSPWT

SEQ ID NO: 8385 - protein, 221 aa, Artificial Sequence
  Description of Artificial Sequence: Synthetic polypeptide
  XENP019289 [CTLA-4]_H0.79_L0_Fab Heavy Chain
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8386 - protein, 118 aa, Artificial Sequence; identical to SEQ ID NO: 5571
  Description of Artificial Sequence: Synthetic polypeptide
  VH of XENP019289

SEQ ID NO: 8387 - protein, 5 aa, Artificial Sequence
  Description of Artificial Sequence: Synthetic peptide
  XENP019289 vhCDR1
SYTMH

SEQ ID NO: 8388 - protein, 17 aa, Artificial Sequence
  Description of Artificial Sequence: Synthetic peptide
  XENP019289 vhCDR2
FISYDGNNKAYADSVKG

SEQ ID NO: 8389 - protein, 9 aa, Artificial Sequence
  Description of Artificial Sequence: Synthetic peptide
  XENP019289 vhCDR3
TGWLGPFDY

SEQ ID NO: 8390 - protein, 215 aa, Artificial Sequence; identical to SEQ ID NO: 7600
  Description of Artificial Sequence: Synthetic polypeptide
  XENP019289 [CTLA-4]_H0.79_L0_Fab Light Chain

SEQ ID NO: 8391 - protein, 108 aa, Artificial Sequence; identical to SEQ ID NO: 3741
  Description of Artificial Sequence: Synthetic polypeptide
  VL of XENP019289

SEQ ID NO: 8392 - protein, 12 aa, Artificial Sequence
  Description of Artificial Sequence: Synthetic peptide
  XENP019289 vlCDR1
RASQSVGSSYLA

SEQ ID NO: 8393 - protein, 7 aa, Artificial Sequence
  Description of Artificial Sequence: Synthetic peptide
  XENP019289 vlCDR2
GAFSRAT

SEQ ID NO: 8394 - protein, 9 aa, Artificial Sequence
  Description of Artificial Sequence: Synthetic peptide
  XENP019289 vlCDR3
QQYGSSPWT

SEQ ID NO: 8395 - protein, 221 aa, Artificial Sequence
  Description of Artificial Sequence: Synthetic polypeptide
  XENP019290 [CTLA-4]_H0.80_L0_Fab Heavy Chain
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8396 - protein, 118 aa, Artificial Sequence; identical to SEQ ID NO: 5580
  Description of Artificial Sequence: Synthetic polypeptide
  VH of XENP019290

SEQ ID NO: 8397 - protein, 5 aa, Artificial Sequence
  Description of Artificial Sequence: Synthetic peptide
  XENP019290 vhCDR1
SYTMH

SEQ ID NO: 8398 - protein, 17 aa, Artificial Sequence
  Description of Artificial Sequence: Synthetic peptide
  XENP019290 vhCDR2
FISYDGNNKYYAASVKG

SEQ ID NO: 8399 - protein, 9 aa, Artificial Sequence
  Description of Artificial Sequence: Synthetic peptide
  XENP019290 vhCDR3
TGWLGPFDY

SEQ ID NO: 8400 - protein, 215 aa, Artificial Sequence; identical to SEQ ID NO: 7600
  Description of Artificial Sequence: Synthetic polypeptide
  XENP019290 [CTLA-4]_H0.80_L0_Fab Light Chain

SEQ ID NO: 8401 - protein, 108 aa, Artificial Sequence; identical to SEQ ID NO: 3741
  Description of Artificial Sequence: Synthetic polypeptide
  VL of XENP019290

SEQ ID NO: 8402 - protein, 12 aa, Artificial Sequence
  Description of Artificial Sequence: Synthetic peptide
  XENP019290 vlCDR1
RASQSVGSSYLA

SEQ ID NO: 8403 - protein, 7 aa, Artificial Sequence
  Description of Artificial Sequence: Synthetic peptide
  XENP019290 vlCDR2
GAFSRAT

SEQ ID NO: 8404 - protein, 9 aa, Artificial Sequence
  Description of Artificial Sequence: Synthetic peptide
  XENP019290 vlCDR3
QQYGSSPWT

SEQ ID NO: 8405 - protein, 221 aa, Artificial Sequence
  Description of Artificial Sequence: Synthetic polypeptide
  XENP019291 [CTLA-4]_H0.81_L0_Fab Heavy Chain
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8406 - protein, 118 aa, Artificial Sequence; identical to SEQ ID NO: 5589
  Description of Artificial Sequence: Synthetic polypeptide
  VH of XENP019291

SEQ ID NO: 8407 - protein, 5 aa, Artificial Sequence
  Description of Artificial Sequence: Synthetic peptide
  XENP019291 vhCDR1
SYTMH

SEQ ID NO: 8408 - protein, 17 aa, Artificial Sequence
  Description of Artificial Sequence: Synthetic peptide
  XENP019291 vhCDR2
FISYDGNNKYYAKSVKG

SEQ ID NO: 8409 - protein, 9 aa, Artificial Sequence
  Description of Artificial Sequence: Synthetic peptide
  XENP019291 vhCDR3
TGWLGPFDY

SEQ ID NO: 8410 - protein, 215 aa, Artificial Sequence; identical to SEQ ID NO: 7600
  Description of Artificial Sequence: Synthetic polypeptide
  XENP019291 [CTLA-4]_H0.81_L0_Fab Light Chain

SEQ ID NO: 8411 - protein, 108 aa, Artificial Sequence; identical to SEQ ID NO: 3741
  Description of Artificial Sequence: Synthetic polypeptide
  VL of XENP019291

SEQ ID NO: 8412 - protein, 12 aa, Artificial Sequence
  Description of Artificial Sequence: Synthetic peptide
  XENP019291 vlCDR1
RASQSVGSSYLA

SEQ ID NO: 8413 - protein, 7 aa, Artificial Sequence
  Description of Artificial Sequence: Synthetic peptide
  XENP019291 vlCDR2
GAFSRAT

SEQ ID NO: 8414 - protein, 9 aa, Artificial Sequence
  Description of Artificial Sequence: Synthetic peptide
  XENP019291 vlCDR3
QQYGSSPWT

SEQ ID NO: 8415 - protein, 221 aa, Artificial Sequence
  Description of Artificial Sequence: Synthetic polypeptide
  XENP019292 [CTLA-4]_H0.82_L0_Fab Heavy Chain
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8416 - protein, 118 aa, Artificial Sequence; identical to SEQ ID NO: 5598
  Description of Artificial Sequence: Synthetic polypeptide
  VH of XENP019292

SEQ ID NO: 8417 - protein, 5 aa, Artificial Sequence
  Description of Artificial Sequence: Synthetic peptide
  XENP019292 vhCDR1
SYTMH

SEQ ID NO: 8418 - protein, 17 aa, Artificial Sequence
  Description of Artificial Sequence: Synthetic peptide
  XENP019292 vhCDR2
FISYDGNNKYYADSVKD

SEQ ID NO: 8419 - protein, 9 aa, Artificial Sequence
  Description of Artificial Sequence: Synthetic peptide
  XENP019292 vhCDR3
TGWLGPFDY

SEQ ID NO: 8420 - protein, 215 aa, Artificial Sequence; identical to SEQ ID NO: 7600
  Description of Artificial Sequence: Synthetic polypeptide
  XENP019292 [CTLA-4]_H0.82_L0_Fab Light Chain

SEQ ID NO: 8421 - protein, 108 aa, Artificial Sequence; identical to SEQ ID NO: 3741
  Description of Artificial Sequence: Synthetic polypeptide
  VL of XENP019292

SEQ ID NO: 8422 - protein, 12 aa, Artificial Sequence
  Description of Artificial Sequence: Synthetic peptide
  XENP019292 vlCDR1
RASQSVGSSYLA

SEQ ID NO: 8423 - protein, 7 aa, Artificial Sequence
  Description of Artificial Sequence: Synthetic peptide
  XENP019292 vlCDR2
GAFSRAT

SEQ ID NO: 8424 - protein, 9 aa, Artificial Sequence
  Description of Artificial Sequence: Synthetic peptide
  XENP019292 vlCDR3
QQYGSSPWT

SEQ ID NO: 8425 - protein, 221 aa, Artificial Sequence
  Description of Artificial Sequence: Synthetic polypeptide
  XENP019293 [CTLA-4]_H0.83_L0_Fab Heavy Chain
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8426 - protein, 118 aa, Artificial Sequence; identical to SEQ ID NO: 5607
  Description of Artificial Sequence: Synthetic polypeptide
  VH of XENP019293

SEQ ID NO: 8427 - protein, 5 aa, Artificial Sequence
  Description of Artificial Sequence: Synthetic peptide
  XENP019293 vhCDR1
SYTMH

SEQ ID NO: 8428 - protein, 17 aa, Artificial Sequence
  Description of Artificial Sequence: Synthetic peptide
  XENP019293 vhCDR2
FISYDGNNKYYADSVKE

SEQ ID NO: 8429 - protein, 9 aa, Artificial Sequence
  Description of Artificial Sequence: Synthetic peptide
  XENP019293 vhCDR3
TGWLGPFDY

SEQ ID NO: 8430 - protein, 215 aa, Artificial Sequence; identical to SEQ ID NO: 7600
  Description of Artificial Sequence: Synthetic polypeptide
  XENP019293 [CTLA-4]_H0.83_L0_Fab Light Chain

SEQ ID NO: 8431 - protein, 108 aa, Artificial Sequence; identical to SEQ ID NO: 3741
  Description of Artificial Sequence: Synthetic polypeptide
  VL of XENP019293

SEQ ID NO: 8432 - protein, 12 aa, Artificial Sequence
  Description of Artificial Sequence: Synthetic peptide
  XENP019293 vlCDR1
RASQSVGSSYLA

SEQ ID NO: 8433 - protein, 7 aa, Artificial Sequence
  Description of Artificial Sequence: Synthetic peptide
  XENP019293 vlCDR2
GAFSRAT

SEQ ID NO: 8434 - protein, 9 aa, Artificial Sequence
  Description of Artificial Sequence: Synthetic peptide
  XENP019293 vlCDR3
QQYGSSPWT

SEQ ID NO: 8435 - protein, 221 aa, Artificial Sequence
  Description of Artificial Sequence: Synthetic polypeptide
  XENP019294 [CTLA-4]_H0.84_L0_Fab Heavy Chain
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8436 - protein, 118 aa, Artificial Sequence; identical to SEQ ID NO: 5616
  Description of Artificial Sequence: Synthetic polypeptide
  VH of XENP019294

SEQ ID NO: 8437 - protein, 5 aa, Artificial Sequence
  Description of Artificial Sequence: Synthetic peptide
  XENP019294 vhCDR1
SYTMH

SEQ ID NO: 8438 - protein, 17 aa, Artificial Sequence
  Description of Artificial Sequence: Synthetic peptide
  XENP019294 vhCDR2
FISYDGNNKYYADSVKG

SEQ ID NO: 8439 - protein, 9 aa, Artificial Sequence
  Description of Artificial Sequence: Synthetic peptide
  XENP019294 vhCDR3
TGWLGPFDY

SEQ ID NO: 8440 - protein, 215 aa, Artificial Sequence; identical to SEQ ID NO: 7600
  Description of Artificial Sequence: Synthetic polypeptide
  XENP019294 [CTLA-4]_H0.84_L0_Fab Light Chain

SEQ ID NO: 8441 - protein, 108 aa, Artificial Sequence; identical to SEQ ID NO: 3741
  Description of Artificial Sequence: Synthetic polypeptide
  VL of XENP019294

SEQ ID NO: 8442 - protein, 12 aa, Artificial Sequence
  Description of Artificial Sequence: Synthetic peptide
  XENP019294 vlCDR1
RASQSVGSSYLA

SEQ ID NO: 8443 - protein, 7 aa, Artificial Sequence
  Description of Artificial Sequence: Synthetic peptide
  XENP019294 vlCDR2
GAFSRAT

SEQ ID NO: 8444 - protein, 9 aa, Artificial Sequence
  Description of Artificial Sequence: Synthetic peptide
  XENP019294 vlCDR3
QQYGSSPWT

SEQ ID NO: 8445 - protein, 221 aa, Artificial Sequence
  Description of Artificial Sequence: Synthetic polypeptide
  XENP019295 [CTLA-4]_H0.85_L0_Fab Heavy Chain
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8446 - protein, 118 aa, Artificial Sequence; identical to SEQ ID NO: 5625
  Description of Artificial Sequence: Synthetic polypeptide
  VH of XENP019295

SEQ ID NO: 8447 - protein, 5 aa, Artificial Sequence
  Description of Artificial Sequence: Synthetic peptide
  XENP019295 vhCDR1
SYTMH

SEQ ID NO: 8448 - protein, 17 aa, Artificial Sequence
  Description of Artificial Sequence: Synthetic peptide
  XENP019295 vhCDR2
FISYDGNNKYYADSVKG

SEQ ID NO: 8449 - protein, 9 aa, Artificial Sequence
  Description of Artificial Sequence: Synthetic peptide
  XENP019295 vhCDR3
TGWLGPFDY

SEQ ID NO: 8450 - protein, 215 aa, Artificial Sequence; identical to SEQ ID NO: 7600
  Description of Artificial Sequence: Synthetic polypeptide
  XENP019295 [CTLA-4]_H0.85_L0_Fab Light Chain

SEQ ID NO: 8451 - protein, 108 aa, Artificial Sequence; identical to SEQ ID NO: 3741
  Description of Artificial Sequence: Synthetic polypeptide
  VL of XENP019295

SEQ ID NO: 8452 - protein, 12 aa, Artificial Sequence
  Description of Artificial Sequence: Synthetic peptide
  XENP019295 vlCDR1
RASQSVGSSYLA

SEQ ID NO: 8453 - protein, 7 aa, Artificial Sequence
  Description of Artificial Sequence: Synthetic peptide
  XENP019295 vlCDR2
GAFSRAT

SEQ ID NO: 8454 - protein, 9 aa, Artificial Sequence
  Description of Artificial Sequence: Synthetic peptide
  XENP019295 vlCDR3
QQYGSSPWT

SEQ ID NO: 8455 - protein, 221 aa, Artificial Sequence
  Description of Artificial Sequence: Synthetic polypeptide
  XENP019296 [CTLA-4]_H0.86_L0_Fab Heavy Chain
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8456 - protein, 118 aa, Artificial Sequence; identical to SEQ ID NO: 5634
  Description of Artificial Sequence: Synthetic polypeptide
  VH of XENP019296

SEQ ID NO: 8457 - protein, 5 aa, Artificial Sequence
  Description of Artificial Sequence: Synthetic peptide
  XENP019296 vhCDR1
SYTMH

SEQ ID NO: 8458 - protein, 17 aa, Artificial Sequence
  Description of Artificial Sequence: Synthetic peptide
  XENP019296 vhCDR2
FISYDGNNKYYADSVKG

SEQ ID NO: 8459 - protein, 9 aa, Artificial Sequence
  Description of Artificial Sequence: Synthetic peptide
  XENP019296 vhCDR3
TGWLGPFDY

SEQ ID NO: 8460 - protein, 215 aa, Artificial Sequence; identical to SEQ ID NO: 7600
  Description of Artificial Sequence: Synthetic polypeptide
  XENP019296 [CTLA-4]_H0.86_L0_Fab Light Chain

SEQ ID NO: 8461 - protein, 108 aa, Artificial Sequence; identical to SEQ ID NO: 3741
  Description of Artificial Sequence: Synthetic polypeptide
  VL of XENP019296

SEQ ID NO: 8462 - protein, 12 aa, Artificial Sequence
  Description of Artificial Sequence: Synthetic peptide
  XENP019296 vlCDR1
RASQSVGSSYLA

SEQ ID NO: 8463 - protein, 7 aa, Artificial Sequence
  Description of Artificial Sequence: Synthetic peptide
  XENP019296 vlCDR2
GAFSRAT

SEQ ID NO: 8464 - protein, 9 aa, Artificial Sequence
  Description of Artificial Sequence: Synthetic peptide
  XENP019296 vlCDR3
QQYGSSPWT

SEQ ID NO: 8465 - protein, 221 aa, Artificial Sequence
  Description of Artificial Sequence: Synthetic polypeptide
  XENP019301 [CTLA-4]_H0.87_L0_Fab Heavy Chain
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8466 - protein, 118 aa, Artificial Sequence; identical to SEQ ID NO: 5643
  Description of Artificial Sequence: Synthetic polypeptide
  VH of XENP019301

SEQ ID NO: 8467 - protein, 5 aa, Artificial Sequence
  Description of Artificial Sequence: Synthetic peptide
  XENP019301 vhCDR1
SYTMH

SEQ ID NO: 8468 - protein, 17 aa, Artificial Sequence
  Description of Artificial Sequence: Synthetic peptide
  XENP019301 vhCDR2
FISYDGNNKYYADSVKG

SEQ ID NO: 8469 - protein, 9 aa, Artificial Sequence
  Description of Artificial Sequence: Synthetic peptide
  XENP019301 vhCDR3
TGWLGPFDY

SEQ ID NO: 8470 - protein, 215 aa, Artificial Sequence; identical to SEQ ID NO: 7600
  Description of Artificial Sequence: Synthetic polypeptide
  XENP019301 [CTLA-4]_H0.87_L0_Fab Light Chain

SEQ ID NO: 8471 - protein, 108 aa, Artificial Sequence; identical to SEQ ID NO: 3741
  Description of Artificial Sequence: Synthetic polypeptide
  VL of XENP019301

SEQ ID NO: 8472 - protein, 12 aa, Artificial Sequence
  Description of Artificial Sequence: Synthetic peptide
  XENP019301 vlCDR1
RASQSVGSSYLA

SEQ ID NO: 8473 - protein, 7 aa, Artificial Sequence
  Description of Artificial Sequence: Synthetic peptide
  XENP019301 vlCDR2
GAFSRAT

SEQ ID NO: 8474 - protein, 9 aa, Artificial Sequence
  Description of Artificial Sequence: Synthetic peptide
  XENP019301 vlCDR3
QQYGSSPWT

SEQ ID NO: 8475 - protein, 221 aa, Artificial Sequence
  Description of Artificial Sequence: Synthetic polypeptide
  XENP019302 [CTLA-4]_H0.88_L0_Fab Heavy Chain
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8476 - protein, 118 aa, Artificial Sequence; identical to SEQ ID NO: 5652
  Description of Artificial Sequence: Synthetic polypeptide
  VH of XENP019302

SEQ ID NO: 8477 - protein, 5 aa, Artificial Sequence
  Description of Artificial Sequence: Synthetic peptide
  XENP019302 vhCDR1
SYTMH

SEQ ID NO: 8478 - protein, 17 aa, Artificial Sequence
  Description of Artificial Sequence: Synthetic peptide
  XENP019302 vhCDR2
FISYDGNNKYYADSVKG

SEQ ID NO: 8479 - protein, 9 aa, Artificial Sequence
  Description of Artificial Sequence: Synthetic peptide
  XENP019302 vhCDR3
TGWLGPFDY

SEQ ID NO: 8480 - protein, 215 aa, Artificial Sequence; identical to SEQ ID NO: 7600
  Description of Artificial Sequence: Synthetic polypeptide
  XENP019302 [CTLA-4]_H0.88_L0_Fab Light Chain

SEQ ID NO: 8481 - protein, 108 aa, Artificial Sequence; identical to SEQ ID NO: 3741
  Description of Artificial Sequence: Synthetic polypeptide
  VL of XENP019302

SEQ ID NO: 8482 - protein, 12 aa, Artificial Sequence
  Description of Artificial Sequence: Synthetic peptide
  XENP019302 vlCDR1
RASQSVGSSYLA

SEQ ID NO: 8483 - protein, 7 aa, Artificial Sequence
  Description of Artificial Sequence: Synthetic peptide
  XENP019302 vlCDR2
GAFSRAT

SEQ ID NO: 8484 - protein, 9 aa, Artificial Sequence
  Description of Artificial Sequence: Synthetic peptide
  XENP019302 vlCDR3
QQYGSSPWT

SEQ ID NO: 8485 - protein, 221 aa, Artificial Sequence
  Description of Artificial Sequence: Synthetic polypeptide
  XENP019303 [CTLA-4]_H0.89_L0_Fab Heavy Chain
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8486 - protein, 118 aa, Artificial Sequence; identical to SEQ ID NO: 5661
  Description of Artificial Sequence: Synthetic polypeptide
  VH of XENP019303

SEQ ID NO: 8487 - protein, 5 aa, Artificial Sequence
  Description of Artificial Sequence: Synthetic peptide
  XENP019303 vhCDR1
SYTMH

SEQ ID NO: 8488 - protein, 17 aa, Artificial Sequence
  Description of Artificial Sequence: Synthetic peptide
  XENP019303 vhCDR2
FISYDGNNKYYADSVKG

SEQ ID NO: 8489 - protein, 9 aa, Artificial Sequence
  Description of Artificial Sequence: Synthetic peptide
  XENP019303 vhCDR3
TGWLGPFDY

SEQ ID NO: 8490 - protein, 215 aa, Artificial Sequence; identical to SEQ ID NO: 7600
  Description of Artificial Sequence: Synthetic polypeptide
  XENP019303 [CTLA-4]_H0.89_L0_Fab Light Chain

SEQ ID NO: 8491 - protein, 108 aa, Artificial Sequence; identical to SEQ ID NO: 3741
  Description of Artificial Sequence: Synthetic polypeptide
  VL of XENP019303

SEQ ID NO: 8492 - protein, 12 aa, Artificial Sequence
  Description of Artificial Sequence: Synthetic peptide
  XENP019303 vlCDR1
RASQSVGSSYLA

SEQ ID NO: 8493 - protein, 7 aa, Artificial Sequence
  Description of Artificial Sequence: Synthetic peptide
  XENP019303 vlCDR2
GAFSRAT

SEQ ID NO: 8494 - protein, 9 aa, Artificial Sequence
  Description of Artificial Sequence: Synthetic peptide
  XENP019303 vlCDR3
QQYGSSPWT

SEQ ID NO: 8495 - protein, 221 aa, Artificial Sequence
  Description of Artificial Sequence: Synthetic polypeptide
  XENP019304 [CTLA-4]_H0.90_L0_Fab Heavy Chain
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8496 - protein, 118 aa, Artificial Sequence; identical to SEQ ID NO: 5670
  Description of Artificial Sequence: Synthetic polypeptide
  VH of XENP019304

SEQ ID NO: 8497 - protein, 5 aa, Artificial Sequence
  Description of Artificial Sequence: Synthetic peptide
  XENP019304 vhCDR1
SYTMH

SEQ ID NO: 8498 - protein, 17 aa, Artificial Sequence
  Description of Artificial Sequence: Synthetic peptide
  XENP019304 vhCDR2
FISYDGNNKYYADSVKG

SEQ ID NO: 8499 - protein, 9 aa, Artificial Sequence
  Description of Artificial Sequence: Synthetic peptide
  XENP019304 vhCDR3
TGWLGPFDY

SEQ ID NO: 8500 - protein, 215 aa, Artificial Sequence; identical to SEQ ID NO: 7600
  Description of Artificial Sequence: Synthetic polypeptide
  XENP019304 [CTLA-4]_H0.90_L0_Fab Light Chain

SEQ ID NO: 8501 - protein, 108 aa, Artificial Sequence; identical to SEQ ID NO: 3741
  Description of Artificial Sequence: Synthetic polypeptide
  VL of XENP019304

SEQ ID NO: 8502 - protein, 12 aa, Artificial Sequence
  Description of Artificial Sequence: Synthetic peptide
  XENP019304 vlCDR1
RASQSVGSSYLA

SEQ ID NO: 8503 - protein, 7 aa, Artificial Sequence
  Description of Artificial Sequence: Synthetic peptide
  XENP019304 vlCDR2
GAFSRAT

SEQ ID NO: 8504 - protein, 9 aa, Artificial Sequence
  Description of Artificial Sequence: Synthetic peptide
  XENP019304 vlCDR3
QQYGSSPWT

SEQ ID NO: 8505 - protein, 221 aa, Artificial Sequence
  Description of Artificial Sequence: Synthetic polypeptide
  XENP019305 [CTLA-4]_H0.91_L0_Fab Heavy Chain
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8506 - protein, 118 aa, Artificial Sequence; identical to SEQ ID NO: 5679
  Description of Artificial Sequence: Synthetic polypeptide
  VH of XENP019305

SEQ ID NO: 8507 - protein, 5 aa, Artificial Sequence
  Description of Artificial Sequence: Synthetic peptide
  XENP019305 vhCDR1
SYTMH

SEQ ID NO: 8508 - protein, 17 aa, Artificial Sequence
  Description of Artificial Sequence: Synthetic peptide
  XENP019305 vhCDR2
FISYDGNNKYYADSVKG

SEQ ID NO: 8509 - protein, 9 aa, Artificial Sequence
  Description of Artificial Sequence: Synthetic peptide
  XENP019305 vhCDR3
TGWLGPFDY

SEQ ID NO: 8510 - protein, 215 aa, Artificial Sequence; identical to SEQ ID NO: 7600
  Description of Artificial Sequence: Synthetic polypeptide
  XENP019305 [CTLA-4]_H0.91_L0_Fab Light Chain

SEQ ID NO: 8511 - protein, 108 aa, Artificial Sequence; identical to SEQ ID NO: 3741
  Description of Artificial Sequence: Synthetic polypeptide
  VL of XENP019305

SEQ ID NO: 8512 - protein, 12 aa, Artificial Sequence
  Description of Artificial Sequence: Synthetic peptide
  XENP019305 vlCDR1
RASQSVGSSYLA

SEQ ID NO: 8513 - protein, 7 aa, Artificial Sequence
  Description of Artificial Sequence: Synthetic peptide
  XENP019305 vlCDR2
GAFSRAT

SEQ ID NO: 8514 - protein, 9 aa, Artificial Sequence
  Description of Artificial Sequence: Synthetic peptide
  XENP019305 vlCDR3
QQYGSSPWT

SEQ ID NO: 8515 - protein, 221 aa, Artificial Sequence
  Description of Artificial Sequence: Synthetic polypeptide
  XENP019306 [CTLA-4]_H0.92_L0_Fab Heavy Chain
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8516 - protein, 118 aa, Artificial Sequence; identical to SEQ ID NO: 5688
  Description of Artificial Sequence: Synthetic polypeptide
  VH of XENP019306

SEQ ID NO: 8517 - protein, 5 aa, Artificial Sequence
  Description of Artificial Sequence: Synthetic peptide
  XENP019306 vhCDR1
SYTMH

SEQ ID NO: 8518 - protein, 17 aa, Artificial Sequence
  Description of Artificial Sequence: Synthetic peptide
  XENP019306 vhCDR2
FISYDGNNKYYADSVKG

SEQ ID NO: 8519 - protein, 9 aa, Artificial Sequence
  Description of Artificial Sequence: Synthetic peptide
  XENP019306 vhCDR3
TGWLGPFDY

SEQ ID NO: 8520 - protein, 215 aa, Artificial Sequence; identical to SEQ ID NO: 7600
  Description of Artificial Sequence: Synthetic polypeptide
  XENP019306 [CTLA-4]_H0.92_L0_Fab Light Chain

SEQ ID NO: 8521 - protein, 108 aa, Artificial Sequence; identical to SEQ ID NO: 3741
  Description of Artificial Sequence: Synthetic polypeptide
  VL of XENP019306

SEQ ID NO: 8522 - protein, 12 aa, Artificial Sequence
  Description of Artificial Sequence: Synthetic peptide
  XENP019306 vlCDR1
RASQSVGSSYLA

SEQ ID NO: 8523 - protein, 7 aa, Artificial Sequence
  Description of Artificial Sequence: Synthetic peptide
  XENP019306 vlCDR2
GAFSRAT

SEQ ID NO: 8524 - protein, 9 aa, Artificial Sequence
  Description of Artificial Sequence: Synthetic peptide
  XENP019306 vlCDR3
QQYGSSPWT

SEQ ID NO: 8525 - protein, 221 aa, Artificial Sequence
  Description of Artificial Sequence: Synthetic polypeptide
  XENP019307 [CTLA-4]_H0.93_L0_Fab Heavy Chain
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8526 - protein, 118 aa, Artificial Sequence; identical to SEQ ID NO: 5697
  Description of Artificial Sequence: Synthetic polypeptide
  VH of XENP019307

SEQ ID NO: 8527 - protein, 5 aa, Artificial Sequence
  Description of Artificial Sequence: Synthetic peptide
  XENP019307 vhCDR1
SYTMH

SEQ ID NO: 8528 - protein, 17 aa, Artificial Sequence
  Description of Artificial Sequence: Synthetic peptide
  XENP019307 vhCDR2
FISYDGNNKYYADSVKG

SEQ ID NO: 8529 - protein, 9 aa, Artificial Sequence
  Description of Artificial Sequence: Synthetic peptide
  XENP019307 vhCDR3
TGWLGPFDY

SEQ ID NO: 8530 - protein, 215 aa, Artificial Sequence; identical to SEQ ID NO: 7600
  Description of Artificial Sequence: Synthetic polypeptide
  XENP019307 [CTLA-4]_H0.93_L0_Fab Light Chain

SEQ ID NO: 8531 - protein, 108 aa, Artificial Sequence; identical to SEQ ID NO: 3741
  Description of Artificial Sequence: Synthetic polypeptide
  VL of XENP019307

SEQ ID NO: 8532 - protein, 12 aa, Artificial Sequence
  Description of Artificial Sequence: Synthetic peptide
  XENP019307 vlCDR1
RASQSVGSSYLA

SEQ ID NO: 8533 - protein, 7 aa, Artificial Sequence
  Description of Artificial Sequence: Synthetic peptide
  XENP019307 vlCDR2
GAFSRAT

SEQ ID NO: 8534 - protein, 9 aa, Artificial Sequence
  Description of Artificial Sequence: Synthetic peptide
  XENP019307 vlCDR3
QQYGSSPWT

SEQ ID NO: 8535 - protein, 221 aa, Artificial Sequence
  Description of Artificial Sequence: Synthetic polypeptide
  XENP019308 [CTLA-4]_H0.94_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8536 - protein, 118 aa, Artificial Sequence; identical to SEQ ID NO: 5706
  Description of Artificial Sequence: Synthetic polypeptide
  VH of XENP019308

SEQ ID NO: 8537 - protein, 5 aa, Artificial Sequence
  Description of Artificial Sequence: Synthetic peptide
  XENP019308 vhCDR1
SYTMH

SEQ ID NO: 8538 - protein, 17 aa, Artificial Sequence
  Description of Artificial Sequence: Synthetic peptide
  XENP019308 vhCDR2
FISYDGNNKYYADSVKG

SEQ ID NO: 8539 - protein, 9 aa, Artificial Sequence
  Description of Artificial Sequence: Synthetic peptide
  XENP019308 vhCDR3
TGWLGPFDY

SEQ ID NO: 8540 - protein, 215 aa, Artificial Sequence; identical to SEQ ID NO: 7600
  Description of Artificial Sequence: Synthetic polypeptide
  XENP019308 [CTLA-4]_H0.94_L0_Fab Light Chain

SEQ ID NO: 8541 - protein, 108 aa, Artificial Sequence; identical to SEQ ID NO: 3741
  Description of Artificial Sequence: Synthetic polypeptide
  VL of XENP019308

SEQ ID NO: 8542 - protein, 12 aa, Artificial Sequence
  Description of Artificial Sequence: Synthetic peptide
  XENP019308 vlCDR1
RASQSVGSSYLA

SEQ ID NO: 8543 - protein, 7 aa, Artificial Sequence
  Description of Artificial Sequence: Synthetic peptide
  XENP019308 vlCDR2
GAFSRAT

SEQ ID NO: 8544 - protein, 9 aa, Artificial Sequence
  Description of Artificial Sequence: Synthetic peptide
  XENP019308 vlCDR3
QQYGSSPWT

SEQ ID NO: 8545 - protein, 221 aa, Artificial Sequence
  Description of Artificial Sequence: Synthetic polypeptide
  XENP019309 [CTLA-4]_H0.95_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8546 - protein, 118 aa, Artificial Sequence; identical to SEQ ID NO: 5715
  Description of Artificial Sequence: Synthetic polypeptide
  VH of XENP019309

SEQ ID NO: 8547 - protein, 5 aa, Artificial Sequence
  Description of Artificial Sequence: Synthetic peptide
  XENP019309 vhCDR1
SYTMH

SEQ ID NO: 8548 - protein, 17 aa, Artificial Sequence
  Description of Artificial Sequence: Synthetic peptide
  XENP019309 vhCDR2
FISYDGNNKYYADSVKG

SEQ ID NO: 8549 - protein, 9 aa, Artificial Sequence
  Description of Artificial Sequence: Synthetic peptide
  XENP019309 vhCDR3
TGWLGPFDY

SEQ ID NO: 8550 - protein, 215 aa, Artificial Sequence; identical to SEQ ID NO: 7600
  Description of Artificial Sequence: Synthetic polypeptide
  XENP019309 [CTLA-4]_H0.95_L0_Fab Light Chain

SEQ ID NO: 8551 - protein, 108 aa, Artificial Sequence; identical to SEQ ID NO: 3741
  Description of Artificial Sequence: Synthetic polypeptide
  VL of XENP019309

SEQ ID NO: 8552 - protein, 12 aa, Artificial Sequence
  Description of Artificial Sequence: Synthetic peptide
  XENP019309 vlCDR1
RASQSVGSSYLA

SEQ ID NO: 8553 - protein, 7 aa, Artificial Sequence
  Description of Artificial Sequence: Synthetic peptide
  XENP019309 vlCDR2
GAFSRAT

SEQ ID NO: 8554 - protein, 9 aa, Artificial Sequence
  Description of Artificial Sequence: Synthetic peptide
  XENP019309 vlCDR3
QQYGSSPWT

SEQ ID NO: 8555 - protein, 221 aa, Artificial Sequence
  Description of Artificial Sequence: Synthetic polypeptide
  XENP019310 [CTLA-4]_H0.96_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8556 - protein, 118 aa, Artificial Sequence; identical to SEQ ID NO: 5724
  Description of Artificial Sequence: Synthetic polypeptide
  VH of XENP019310

SEQ ID NO: 8557 - protein, 5 aa, Artificial Sequence
  Description of Artificial Sequence: Synthetic peptide
  XENP019310 vhCDR1
SYTMH

SEQ ID NO: 8558 - protein, 17 aa, Artificial Sequence
  Description of Artificial Sequence: Synthetic peptide
  XENP019310 vhCDR2
FISYDGNNKYYADSVKG

SEQ ID NO: 8559 - protein, 9 aa, Artificial Sequence
  Description of Artificial Sequence: Synthetic peptide
  XENP019310 vhCDR3
TGWLGPFDY

SEQ ID NO: 8560 - protein, 215 aa, Artificial Sequence; identical to SEQ ID NO: 7600
  Description of Artificial Sequence: Synthetic polypeptide
  XENP019310 [CTLA-4]_H0.96_L0_Fab Light Chain

SEQ ID NO: 8561 - protein, 108 aa, Artificial Sequence; identical to SEQ ID NO: 3741
  Description of Artificial Sequence: Synthetic polypeptide
  VL of XENP019310

SEQ ID NO: 8562 - protein, 12 aa, Artificial Sequence
  Description of Artificial Sequence: Synthetic peptide
  XENP019310 vlCDR1
RASQSVGSSYLA

SEQ ID NO: 8563 - protein, 7 aa, Artificial Sequence
  Description of Artificial Sequence: Synthetic peptide
  XENP019310 vlCDR2
GAFSRAT

SEQ ID NO: 8564 - protein, 9 aa, Artificial Sequence
  Description of Artificial Sequence: Synthetic peptide
  XENP019310 vlCDR3
QQYGSSPWT

SEQ ID NO: 8565 - protein, 221 aa, Artificial Sequence
  Description of Artificial Sequence: Synthetic polypeptide
  XENP019311 [CTLA-4]_H0.97_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8566 - protein, 118 aa, Artificial Sequence; identical to SEQ ID NO: 5733
  Description of Artificial Sequence: Synthetic polypeptide
  VH of XENP019311

SEQ ID NO: 8567 - protein, 5 aa, Artificial Sequence
  Description of Artificial Sequence: Synthetic peptide
  XENP019311 vhCDR1
SYTMH

SEQ ID NO: 8568 - protein, 17 aa, Artificial Sequence
  Description of Artificial Sequence: Synthetic peptide
  XENP019311 vhCDR2
FISYDGNNKYYADSVKG

SEQ ID NO: 8569 - protein, 9 aa, Artificial Sequence
  Description of Artificial Sequence: Synthetic peptide
  XENP019311 vhCDR3
TGWLGPFDY

SEQ ID NO: 8570 - protein, 215 aa, Artificial Sequence; identical to SEQ ID NO: 7600
  Description of Artificial Sequence: Synthetic polypeptide
  XENP019311 [CTLA-4]_H0.97_L0_Fab Light Chain

SEQ ID NO: 8571 - protein, 108 aa, Artificial Sequence; identical to SEQ ID NO: 3741
  Description of Artificial Sequence: Synthetic polypeptide
  VL of XENP019311

SEQ ID NO: 8572 - protein, 12 aa, Artificial Sequence
  Description of Artificial Sequence: Synthetic peptide
  XENP019311 vlCDR1
RASQSVGSSYLA

SEQ ID NO: 8573 - protein, 7 aa, Artificial Sequence
  Description of Artificial Sequence: Synthetic peptide
  XENP019311 vlCDR2
GAFSRAT

SEQ ID NO: 8574 - protein, 9 aa, Artificial Sequence
  Description of Artificial Sequence: Synthetic peptide
  XENP019311 vlCDR3
QQYGSSPWT

SEQ ID NO: 8575 - protein, 221 aa, Artificial Sequence
  Description of Artificial Sequence: Synthetic polypeptide
  XENP019312 [CTLA-4]_H0.98_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8576 - protein, 118 aa, Artificial Sequence; identical to SEQ ID NO: 5742
  Description of Artificial Sequence: Synthetic polypeptide
  VH of XENP019312

SEQ ID NO: 8577 - protein, 5 aa, Artificial Sequence
  Description of Artificial Sequence: Synthetic peptide
  XENP019312 vhCDR1
SYTMH

SEQ ID NO: 8578 - protein, 17 aa, Artificial Sequence
  Description of Artificial Sequence: Synthetic peptide
  XENP019312 vhCDR2
FISYDGNNKYYADSVKG

SEQ ID NO: 8579 - protein, 9 aa, Artificial Sequence
  Description of Artificial Sequence: Synthetic peptide
  XENP019312 vhCDR3
TGWLGPFDY

SEQ ID NO: 8580 - protein, 215 aa, Artificial Sequence; identical to SEQ ID NO: 7600
  Description of Artificial Sequence: Synthetic polypeptide
  XENP019312 [CTLA-4]_H0.98_L0_Fab Light Chain

SEQ ID NO: 8581 - protein, 108 aa, Artificial Sequence; identical to SEQ ID NO: 3741
  Description of Artificial Sequence: Synthetic polypeptide
  VL of XENP019312

SEQ ID NO: 8582 - protein, 12 aa, Artificial Sequence
  Description of Artificial Sequence: Synthetic peptide
  XENP019312 vlCDR1
RASQSVGSSYLA

SEQ ID NO: 8583 - protein, 7 aa, Artificial Sequence
  Description of Artificial Sequence: Synthetic peptide
  XENP019312 vlCDR2
GAFSRAT

SEQ ID NO: 8584 - protein, 9 aa, Artificial Sequence
  Description of Artificial Sequence: Synthetic peptide
  XENP019312 vlCDR3
QQYGSSPWT

SEQ ID NO: 8585 - protein, 221 aa, Artificial Sequence
  Description of Artificial Sequence: Synthetic polypeptide
  XENP019313 [CTLA-4]_H0.99_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8586 - protein, 118 aa, Artificial Sequence; identical to SEQ ID NO: 5751
  Description of Artificial Sequence: Synthetic polypeptide
  VH of XENP019313

SEQ ID NO: 8587 - protein, 5 aa, Artificial Sequence
  Description of Artificial Sequence: Synthetic peptide
  XENP019313 vhCDR1
SYTMH

SEQ ID NO: 8588 - protein, 17 aa, Artificial Sequence
  Description of Artificial Sequence: Synthetic peptide
  XENP019313 vhCDR2
FISYDGNNKYYADSVKG

SEQ ID NO: 8589 - protein, 9 aa, Artificial Sequence
  Description of Artificial Sequence: Synthetic peptide
  XENP019313 vhCDR3
TGWLGPFDY

SEQ ID NO: 8590 - protein, 215 aa, Artificial Sequence; identical to SEQ ID NO: 7600
  Description of Artificial Sequence: Synthetic polypeptide
  XENP019313 [CTLA-4]_H0.99_L0_Fab Light Chain

SEQ ID NO: 8591 - protein, 108 aa, Artificial Sequence; identical to SEQ ID NO: 3741
  Description of Artificial Sequence: Synthetic polypeptide
  VL of XENP019313

SEQ ID NO: 8592 - protein, 12 aa, Artificial Sequence
  Description of Artificial Sequence: Synthetic peptide
  XENP019313 vlCDR1
RASQSVGSSYLA

SEQ ID NO: 8593 - protein, 7 aa, Artificial Sequence
  Description of Artificial Sequence: Synthetic peptide
  XENP019313 vlCDR2
GAFSRAT

SEQ ID NO: 8594 - protein, 9 aa, Artificial Sequence
  Description of Artificial Sequence: Synthetic peptide
  XENP019313 vlCDR3
QQYGSSPWT

SEQ ID NO: 8595 - protein, 221 aa, Artificial Sequence
  Description of Artificial Sequence: Synthetic polypeptide
  XENP019314 [CTLA-4]_H0.100_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8596 - protein, 118 aa, Artificial Sequence; identical to SEQ ID NO: 5760
  Description of Artificial Sequence: Synthetic polypeptide
  VH of XENP019314

SEQ ID NO: 8597 - protein, 5 aa, Artificial Sequence
  Description of Artificial Sequence: Synthetic peptide
  XENP019314 vhCDR1
SYTMH

SEQ ID NO: 8598 - protein, 17 aa, Artificial Sequence
  Description of Artificial Sequence: Synthetic peptide
  XENP019314 vhCDR2
FISYDGNNKYYADSVKG

SEQ ID NO: 8599 - protein, 9 aa, Artificial Sequence
  Description of Artificial Sequence: Synthetic peptide
  XENP019314 vhCDR3
TGWLGPFDY

SEQ ID NO: 8600 - protein, 215 aa, Artificial Sequence; identical to SEQ ID NO: 7600
  Description of Artificial Sequence: Synthetic polypeptide
  XENP019314 [CTLA-4]_H0.100_L0_Fab Light Chain

SEQ ID NO: 8601 - protein, 108 aa, Artificial Sequence; identical to SEQ ID NO: 3741
  Description of Artificial Sequence: Synthetic polypeptide
  VL of XENP019314

SEQ ID NO: 8602 - protein, 12 aa, Artificial Sequence
  Description of Artificial Sequence: Synthetic peptide
  XENP019314 vlCDR1
RASQSVGSSYLA

SEQ ID NO: 8603 - protein, 7 aa, Artificial Sequence
  Description of Artificial Sequence: Synthetic peptide
  XENP019314 vlCDR2
GAFSRAT

SEQ ID NO: 8604 - protein, 9 aa, Artificial Sequence
  Description of Artificial Sequence: Synthetic peptide
  XENP019314 vlCDR3
QQYGSSPWT

SEQ ID NO: 8605 - protein, 221 aa, Artificial Sequence
  Description of Artificial Sequence: Synthetic polypeptide
  XENP019315 [CTLA-4]_H0.101_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8606 - protein, 118 aa, Artificial Sequence; identical to SEQ ID NO: 5769
  Description of Artificial Sequence: Synthetic polypeptide
  VH of XENP019315

SEQ ID NO: 8607 - protein, 5 aa, Artificial Sequence
  Description of Artificial Sequence: Synthetic peptide
  XENP019315 vhCDR1
SYTMH

SEQ ID NO: 8608 - protein, 17 aa, Artificial Sequence
  Description of Artificial Sequence: Synthetic peptide
  XENP019315 vhCDR2
FISYDGNNKYYADSVKG

SEQ ID NO: 8609 - protein, 9 aa, Artificial Sequence
  Description of Artificial Sequence: Synthetic peptide
  XENP019315 vhCDR3
TGWLGPFDY

SEQ ID NO: 8610 - protein, 215 aa, Artificial Sequence; identical to SEQ ID NO: 7600
  Description of Artificial Sequence: Synthetic polypeptide
  XENP019315 [CTLA-4]_H0.101_L0_Fab Light Chain

SEQ ID NO: 8611 - protein, 108 aa, Artificial Sequence; identical to SEQ ID NO: 3741
  Description of Artificial Sequence: Synthetic polypeptide
  VL of XENP019315

SEQ ID NO: 8612 - protein, 12 aa, Artificial Sequence
  Description of Artificial Sequence: Synthetic peptide
  XENP019315 vlCDR1
RASQSVGSSYLA

SEQ ID NO: 8613 - protein, 7 aa, Artificial Sequence
  Description of Artificial Sequence: Synthetic peptide
  XENP019315 vlCDR2
GAFSRAT

SEQ ID NO: 8614 - protein, 9 aa, Artificial Sequence
  Description of Artificial Sequence: Synthetic peptide
  XENP019315 vlCDR3
QQYGSSPWT

SEQ ID NO: 8615 - protein, 221 aa, Artificial Sequence
  Description of Artificial Sequence: Synthetic polypeptide
  XENP019316 [CTLA-4]_H0.102_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8616 - protein, 118 aa, Artificial Sequence; identical to SEQ ID NO: 5778
  Description of Artificial Sequence: Synthetic polypeptide
  VH of XENP019316

SEQ ID NO: 8617 - protein, 5 aa, Artificial Sequence
  Description of Artificial Sequence: Synthetic peptide
  XENP019316 vhCDR1
SYTMH

SEQ ID NO: 8618 - protein, 17 aa, Artificial Sequence
  Description of Artificial Sequence: Synthetic peptide
  XENP019316 vhCDR2
FISYDGNNKYYADSVKG

SEQ ID NO: 8619 - protein, 9 aa, Artificial Sequence
  Description of Artificial Sequence: Synthetic peptide
  XENP019316 vhCDR3
AGWLGPFDY

SEQ ID NO: 8620 - protein, 215 aa, Artificial Sequence; identical to SEQ ID NO: 7600
  Description of Artificial Sequence: Synthetic polypeptide
  XENP019316 [CTLA-4]_H0.102_L0_Fab Light Chain

SEQ ID NO: 8621 - protein, 108 aa, Artificial Sequence; identical to SEQ ID NO: 3741
  Description of Artificial Sequence: Synthetic polypeptide
  VL of XENP019316

SEQ ID NO: 8622 - protein, 12 aa, Artificial Sequence
  Description of Artificial Sequence: Synthetic peptide
  XENP019316 vlCDR1
RASQSVGSSYLA

SEQ ID NO: 8623 - protein, 7 aa, Artificial Sequence
  Description of Artificial Sequence: Synthetic peptide
  XENP019316 vlCDR2
GAFSRAT

SEQ ID NO: 8624 - protein, 9 aa, Artificial Sequence
  Description of Artificial Sequence: Synthetic peptide
  XENP019316 vlCDR3
QQYGSSPWT

SEQ ID NO: 8625 - protein, 221 aa, Artificial Sequence
  Description of Artificial Sequence: Synthetic polypeptide
  XENP019317 [CTLA-4]_H0.103_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8626 - protein, 118 aa, Artificial Sequence; identical to SEQ ID NO: 5787
  Description of Artificial Sequence: Synthetic polypeptide
  VH of XENP019317

SEQ ID NO: 8627 - protein, 5 aa, Artificial Sequence
  Description of Artificial Sequence: Synthetic peptide
  XENP019317 vhCDR1
SYTMH

SEQ ID NO: 8628 - protein, 17 aa, Artificial Sequence
  Description of Artificial Sequence: Synthetic peptide
  XENP019317 vhCDR2
FISYDGNNKYYADSVKG

SEQ ID NO: 8629 - protein, 9 aa, Artificial Sequence
  Description of Artificial Sequence: Synthetic peptide
  XENP019317 vhCDR3
GGWLGPFDY

SEQ ID NO: 8630 - protein, 215 aa, Artificial Sequence; identical to SEQ ID NO: 7600
  Description of Artificial Sequence: Synthetic polypeptide
  XENP019317 [CTLA-4]_H0.103_L0_Fab Light Chain

SEQ ID NO: 8631 - protein, 108 aa, Artificial Sequence; identical to SEQ ID NO: 3741
  Description of Artificial Sequence: Synthetic polypeptide
  VL of XENP019317

SEQ ID NO: 8632 - protein, 12 aa, Artificial Sequence
  Description of Artificial Sequence: Synthetic peptide
  XENP019317 vlCDR1
RASQSVGSSYLA

SEQ ID NO: 8633 - protein, 7 aa, Artificial Sequence
  Description of Artificial Sequence: Synthetic peptide
  XENP019317 vlCDR2
GAFSRAT

SEQ ID NO: 8634 - protein, 9 aa, Artificial Sequence
  Description of Artificial Sequence: Synthetic peptide
  XENP019317 vlCDR3
QQYGSSPWT

SEQ ID NO: 8635 - protein, 221 aa, Artificial Sequence
  Description of Artificial Sequence: Synthetic polypeptide
  XENP019318 [CTLA-4]_H0.104_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8636 - protein, 118 aa, Artificial Sequence; identical to SEQ ID NO: 5796
  Description of Artificial Sequence: Synthetic polypeptide
  VH of XENP019318

SEQ ID NO: 8637 - protein, 5 aa, Artificial Sequence
  Description of Artificial Sequence: Synthetic peptide
  XENP019318 vhCDR1
SYTMH

SEQ ID NO: 8638 - protein, 17 aa, Artificial Sequence
  Description of Artificial Sequence: Synthetic peptide
  XENP019318 vhCDR2
FISYDGNNKYYADSVKG

SEQ ID NO: 8639 - protein, 9 aa, Artificial Sequence
  Description of Artificial Sequence: Synthetic peptide
  XENP019318 vhCDR3
DGWLGPFDY

SEQ ID NO: 8640 - protein, 215 aa, Artificial Sequence; identical to SEQ ID NO: 7600
  Description of Artificial Sequence: Synthetic polypeptide
  XENP019318 [CTLA-4]_H0.104_L0_Fab Light Chain

SEQ ID NO: 8641 - protein, 108 aa, Artificial Sequence; identical to SEQ ID NO: 3741
  Description of Artificial Sequence: Synthetic polypeptide
  VL of XENP019318

SEQ ID NO: 8642 - protein, 12 aa, Artificial Sequence
  Description of Artificial Sequence: Synthetic peptide
  XENP019318 vlCDR1
RASQSVGSSYLA

SEQ ID NO: 8643 - protein, 7 aa, Artificial Sequence
  Description of Artificial Sequence: Synthetic peptide
  XENP019318 vlCDR2
GAFSRAT

SEQ ID NO: 8644 - protein, 9 aa, Artificial Sequence
  Description of Artificial Sequence: Synthetic peptide
  XENP019318 vlCDR3
QQYGSSPWT

SEQ ID NO: 8645 - protein, 221 aa, Artificial Sequence
  Description of Artificial Sequence: Synthetic polypeptide
  XENP019319 [CTLA-4]_H0.105_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8646 - protein, 118 aa, Artificial Sequence; identical to SEQ ID NO: 5805
  Description of Artificial Sequence: Synthetic polypeptide
  VH of XENP019319

SEQ ID NO: 8647 - protein, 5 aa, Artificial Sequence
  Description of Artificial Sequence: Synthetic peptide
  XENP019319 vhCDR1
SYTMH

SEQ ID NO: 8648 - protein, 17 aa, Artificial Sequence
  Description of Artificial Sequence: Synthetic peptide
  XENP019319 vhCDR2
FISYDGNNKYYADSVKG

SEQ ID NO: 8649 - protein, 9 aa, Artificial Sequence
  Description of Artificial Sequence: Synthetic peptide
  XENP019319 vhCDR3
SGWLGPFDY

SEQ ID NO: 8650 - protein, 215 aa, Artificial Sequence; identical to SEQ ID NO: 7600
  Description of Artificial Sequence: Synthetic polypeptide
  XENP019319 [CTLA-4]_H0.105_L0_Fab Light Chain

SEQ ID NO: 8651 - protein, 108 aa, Artificial Sequence; identical to SEQ ID NO: 3741
  Description of Artificial Sequence: Synthetic polypeptide
  VL of XENP019319

SEQ ID NO: 8652 - protein, 12 aa, Artificial Sequence
  Description of Artificial Sequence: Synthetic peptide
  XENP019319 vlCDR1
RASQSVGSSYLA

SEQ ID NO: 8653 - protein, 7 aa, Artificial Sequence
  Description of Artificial Sequence: Synthetic peptide
  XENP019319 vlCDR2
GAFSRAT

SEQ ID NO: 8654 - protein, 9 aa, Artificial Sequence
  Description of Artificial Sequence: Synthetic peptide
  XENP019319 vlCDR3
QQYGSSPWT

SEQ ID NO: 8655 - protein, 221 aa, Artificial Sequence
  Description of Artificial Sequence: Synthetic polypeptide
  XENP019320 [CTLA-4]_H0.106_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8656 - protein, 118 aa, Artificial Sequence; identical to SEQ ID NO: 5814
  Description of Artificial Sequence: Synthetic polypeptide
  VH of XENP019320

SEQ ID NO: 8657 - protein, 5 aa, Artificial Sequence
  Description of Artificial Sequence: Synthetic peptide
  XENP019320 vhCDR1
SYTMH

SEQ ID NO: 8658 - protein, 17 aa, Artificial Sequence
  Description of Artificial Sequence: Synthetic peptide
  XENP019320 vhCDR2
FISYDGNNKYYADSVKG

SEQ ID NO: 8659 - protein, 9 aa, Artificial Sequence
  Description of Artificial Sequence: Synthetic peptide
  XENP019320 vhCDR3
VGWLGPFDY

SEQ ID NO: 8660 - protein, 215 aa, Artificial Sequence; identical to SEQ ID NO: 7600
  Description of Artificial Sequence: Synthetic polypeptide
  XENP019320 [CTLA-4]_H0.106_L0_Fab Light Chain

SEQ ID NO: 8661 - protein, 108 aa, Artificial Sequence; identical to SEQ ID NO: 3741
  Description of Artificial Sequence: Synthetic polypeptide
  VL of XENP019320

SEQ ID NO: 8662 - protein, 12 aa, Artificial Sequence
  Description of Artificial Sequence: Synthetic peptide
  XENP019320 vlCDR1
RASQSVGSSYLA

SEQ ID NO: 8663 - protein, 7 aa, Artificial Sequence
  Description of Artificial Sequence: Synthetic peptide
  XENP019320 vlCDR2
GAFSRAT

SEQ ID NO: 8664 - protein, 9 aa, Artificial Sequence
  Description of Artificial Sequence: Synthetic peptide
  XENP019320 vlCDR3
QQYGSSPWT

SEQ ID NO: 8665 - protein, 221 aa, Artificial Sequence
  Description of Artificial Sequence: Synthetic polypeptide
  XENP019321 [CTLA-4]_H0.107_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8666 - protein, 118 aa, Artificial Sequence; identical to SEQ ID NO: 5823
  Description of Artificial Sequence: Synthetic polypeptide
  VH of XENP019321

SEQ ID NO: 8667 - protein, 5 aa, Artificial Sequence
  Description of Artificial Sequence: Synthetic peptide
  XENP019321 vhCDR1
SYTMH

SEQ ID NO: 8668 - protein, 17 aa, Artificial Sequence
  Description of Artificial Sequence: Synthetic peptide
  XENP019321 vhCDR2
FISYDGNNKYYADSVKG

SEQ ID NO: 8669 - protein, 9 aa, Artificial Sequence
  Description of Artificial Sequence: Synthetic peptide
  XENP019321 vhCDR3
YGWLGPFDY

SEQ ID NO: 8670 - protein, 215 aa, Artificial Sequence; identical to SEQ ID NO: 7600
  Description of Artificial Sequence: Synthetic polypeptide
  XENP019321 [CTLA-4]_H0.107_L0_Fab Light Chain

SEQ ID NO: 8671 - protein, 108 aa, Artificial Sequence; identical to SEQ ID NO: 3741
  Description of Artificial Sequence: Synthetic polypeptide
  VL of XENP019321

SEQ ID NO: 8672 - protein, 12 aa, Artificial Sequence
  Description of Artificial Sequence: Synthetic peptide
  XENP019321 vlCDR1
RASQSVGSSYLA

SEQ ID NO: 8673 - protein, 7 aa, Artificial Sequence
  Description of Artificial Sequence: Synthetic peptide
  XENP019321 vlCDR2
GAFSRAT

SEQ ID NO: 8674 - protein, 9 aa, Artificial Sequence
  Description of Artificial Sequence: Synthetic peptide
  XENP019321 vlCDR3
QQYGSSPWT

SEQ ID NO: 8675 - protein, 221 aa, Artificial Sequence
  Description of Artificial Sequence: Synthetic polypeptide
  XENP019322 [CTLA-4]_H0.108_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8676 - protein, 118 aa, Artificial Sequence; identical to SEQ ID NO: 5832
  Description of Artificial Sequence: Synthetic polypeptide
  VH of XENP019322

SEQ ID NO: 8677 - protein, 5 aa, Artificial Sequence
  Description of Artificial Sequence: Synthetic peptide
  XENP019322 vhCDR1
SYTMH

SEQ ID NO: 8678 - protein, 17 aa, Artificial Sequence
  Description of Artificial Sequence: Synthetic peptide
  XENP019322 vhCDR2
FISYDGNNKYYADSVKG

SEQ ID NO: 8679 - protein, 9 aa, Artificial Sequence
  Description of Artificial Sequence: Synthetic peptide
  XENP019322 vhCDR3
TAWLGPFDY

SEQ ID NO: 8680 - protein, 215 aa, Artificial Sequence; identical to SEQ ID NO: 7600
  Description of Artificial Sequence: Synthetic polypeptide
  XENP019322 [CTLA-4]_H0.108_L0_Fab Light Chain

SEQ ID NO: 8681 - protein, 108 aa, Artificial Sequence; identical to SEQ ID NO: 3741
  Description of Artificial Sequence: Synthetic polypeptide
  VL of XENP019322

SEQ ID NO: 8682 - protein, 12 aa, Artificial Sequence
  Description of Artificial Sequence: Synthetic peptide
  XENP019322 vlCDR1
RASQSVGSSYLA

SEQ ID NO: 8683 - protein, 7 aa, Artificial Sequence
  Description of Artificial Sequence: Synthetic peptide
  XENP019322 vlCDR2
GAFSRAT

SEQ ID NO: 8684 - protein, 9 aa, Artificial Sequence
  Description of Artificial Sequence: Synthetic peptide
  XENP019322 vlCDR3
QQYGSSPWT

SEQ ID NO: 8685 - protein, 221 aa, Artificial Sequence
  Description of Artificial Sequence: Synthetic polypeptide
  XENP019323 [CTLA-4]_H0.109_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8686 - protein, 118 aa, Artificial Sequence; identical to SEQ ID NO: 5841
  Description of Artificial Sequence: Synthetic polypeptide
  VH of XENP019323

SEQ ID NO: 8687 - protein, 5 aa, Artificial Sequence
  Description of Artificial Sequence: Synthetic peptide
  XENP019323 vhCDR1
SYTMH

SEQ ID NO: 8688 - protein, 17 aa, Artificial Sequence
  Description of Artificial Sequence: Synthetic peptide
  XENP019323 vhCDR2
FISYDGNNKYYADSVKG

SEQ ID NO: 8689 - protein, 9 aa, Artificial Sequence
  Description of Artificial Sequence: Synthetic peptide
  XENP019323 vhCDR3
TSWLGPFDY

SEQ ID NO: 8690 - protein, 215 aa, Artificial Sequence; identical to SEQ ID NO: 7600
  Description of Artificial Sequence: Synthetic polypeptide
  XENP019323 [CTLA-4]_H0.109_L0_Fab Light Chain

SEQ ID NO: 8691 - protein, 108 aa, Artificial Sequence; identical to SEQ ID NO: 3741
  Description of Artificial Sequence: Synthetic polypeptide
  VL of XENP019323

SEQ ID NO: 8692 - protein, 12 aa, Artificial Sequence
  Description of Artificial Sequence: Synthetic peptide
  XENP019323 vlCDR1
RASQSVGSSYLA

SEQ ID NO: 8693 - protein, 7 aa, Artificial Sequence
  Description of Artificial Sequence: Synthetic peptide
  XENP019323 vlCDR2
GAFSRAT

SEQ ID NO: 8694 - protein, 9 aa, Artificial Sequence
  Description of Artificial Sequence: Synthetic peptide
  XENP019323 vlCDR3
QQYGSSPWT

SEQ ID NO: 8695 - protein, 221 aa, Artificial Sequence
  Description of Artificial Sequence: Synthetic polypeptide
  XENP019324 [CTLA-4]_H0.110_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8696 - protein, 118 aa, Artificial Sequence; identical to SEQ ID NO: 5850
  Description of Artificial Sequence: Synthetic polypeptide
  VH of XENP019324

SEQ ID NO: 8697 - protein, 5 aa, Artificial Sequence
  Description of Artificial Sequence: Synthetic peptide
  XENP019324 vhCDR1
SYTMH

SEQ ID NO: 8698 - protein, 17 aa, Artificial Sequence
  Description of Artificial Sequence: Synthetic peptide
  XENP019324 vhCDR2
FISYDGNNKYYADSVKG

SEQ ID NO: 8699 - protein, 9 aa, Artificial Sequence
  Description of Artificial Sequence: Synthetic peptide
  XENP019324 vhCDR3
TTWLGPFDY

SEQ ID NO: 8700 - protein, 215 aa, Artificial Sequence; identical to SEQ ID NO: 7600
  Description of Artificial Sequence: Synthetic polypeptide
  XENP019324 [CTLA-4]_H0.110_L0_Fab Light Chain

SEQ ID NO: 8701 - protein, 108 aa, Artificial Sequence; identical to SEQ ID NO: 3741
  Description of Artificial Sequence: Synthetic polypeptide
  VL of XENP019324

SEQ ID NO: 8702 - protein, 12 aa, Artificial Sequence
  Description of Artificial Sequence: Synthetic peptide
  XENP019324 vlCDR1
RASQSVGSSYLA

SEQ ID NO: 8703 - protein, 7 aa, Artificial Sequence
  Description of Artificial Sequence: Synthetic peptide
  XENP019324 vlCDR2
GAFSRAT

SEQ ID NO: 8704 - protein, 9 aa, Artificial Sequence
  Description of Artificial Sequence: Synthetic peptide
  XENP019324 vlCDR3
QQYGSSPWT

SEQ ID NO: 8705 - protein, 221 aa, Artificial Sequence
  Description of Artificial Sequence: Synthetic polypeptide
  XENP019325 [CTLA-4]_H0.111_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8706 - protein, 118 aa, Artificial Sequence; identical to SEQ ID NO: 5859
  Description of Artificial Sequence: Synthetic polypeptide
  VH of XENP019325

SEQ ID NO: 8707 - protein, 5 aa, Artificial Sequence
  Description of Artificial Sequence: Synthetic peptide
  XENP019325 vhCDR1
SYTMH

SEQ ID NO: 8708 - protein, 17 aa, Artificial Sequence
  Description of Artificial Sequence: Synthetic peptide
  XENP019325 vhCDR2
FISYDGNNKYYADSVKG

SEQ ID NO: 8709 - protein, 9 aa, Artificial Sequence
  Description of Artificial Sequence: Synthetic peptide
  XENP019325 vhCDR3
TGFLGPFDY

SEQ ID NO: 8710 - protein, 215 aa, Artificial Sequence; identical to SEQ ID NO: 7600
  Description of Artificial Sequence: Synthetic polypeptide
  XENP019325 [CTLA-4]_H0.111_L0_Fab Light Chain

SEQ ID NO: 8711 - protein, 108 aa, Artificial Sequence; identical to SEQ ID NO: 3741
  Description of Artificial Sequence: Synthetic polypeptide
  VL of XENP019325

SEQ ID NO: 8712 - protein, 12 aa, Artificial Sequence
  Description of Artificial Sequence: Synthetic peptide
  XENP019325 vlCDR1
RASQSVGSSYLA

SEQ ID NO: 8713 - protein, 7 aa, Artificial Sequence
  Description of Artificial Sequence: Synthetic peptide
  XENP019325 vlCDR2
GAFSRAT

SEQ ID NO: 8714 - protein, 9 aa, Artificial Sequence
  Description of Artificial Sequence: Synthetic peptide
  XENP019325 vlCDR3
QQYGSSPWT

SEQ ID NO: 8715 - protein, 221 aa, Artificial Sequence
  Description of Artificial Sequence: Synthetic polypeptide
  XENP019326 [CTLA-4]_H0.112_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8716 - protein, 118 aa, Artificial Sequence; identical to SEQ ID NO: 5868
  Description of Artificial Sequence: Synthetic polypeptide
  VH of XENP019326

SEQ ID NO: 8717 - protein, 5 aa, Artificial Sequence
  Description of Artificial Sequence: Synthetic peptide
  XENP019326 vhCDR1
SYTMH

SEQ ID NO: 8718 - protein, 17 aa, Artificial Sequence
  Description of Artificial Sequence: Synthetic peptide
  XENP019326 vhCDR2
FISYDGNNKYYADSVKG

SEQ ID NO: 8719 - protein, 9 aa, Artificial Sequence
  Description of Artificial Sequence: Synthetic peptide
  XENP019326 vhCDR3
TGGLGPFDY

SEQ ID NO: 8720 - protein, 215 aa, Artificial Sequence; identical to SEQ ID NO: 7600
  Description of Artificial Sequence: Synthetic polypeptide
  XENP019326 [CTLA-4]_H0.112_L0_Fab Light Chain

SEQ ID NO: 8721 - protein, 108 aa, Artificial Sequence; identical to SEQ ID NO: 3741
  Description of Artificial Sequence: Synthetic polypeptide
  VL of XENP019326

SEQ ID NO: 8722 - protein, 12 aa, Artificial Sequence
  Description of Artificial Sequence: Synthetic peptide
  XENP019326 vlCDR1
RASQSVGSSYLA

SEQ ID NO: 8723 - protein, 7 aa, Artificial Sequence
  Description of Artificial Sequence: Synthetic peptide
  XENP019326 vlCDR2
GAFSRAT

SEQ ID NO: 8724 - protein, 9 aa, Artificial Sequence
  Description of Artificial Sequence: Synthetic peptide
  XENP019326 vlCDR3
QQYGSSPWT

SEQ ID NO: 8725 - protein, 221 aa, Artificial Sequence
  Description of Artificial Sequence: Synthetic polypeptide
  XENP019327 [CTLA-4]_H0.113_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8726 - protein, 118 aa, Artificial Sequence; identical to SEQ ID NO: 5877
  Description of Artificial Sequence: Synthetic polypeptide
  VH of XENP019327

SEQ ID NO: 8727 - protein, 5 aa, Artificial Sequence
  Description of Artificial Sequence: Synthetic peptide
  XENP019327 vhCDR1
SYTMH

SEQ ID NO: 8728 - protein, 17 aa, Artificial Sequence
  Description of Artificial Sequence: Synthetic peptide
  XENP019327 vhCDR2
FISYDGNNKYYADSVKG

SEQ ID NO: 8729 - protein, 9 aa, Artificial Sequence
  Description of Artificial Sequence: Synthetic peptide
  XENP019327 vhCDR3
TGHLGPFDY

SEQ ID NO: 8730 - protein, 215 aa, Artificial Sequence; identical to SEQ ID NO: 7600
  Description of Artificial Sequence: Synthetic polypeptide
  XENP019327 [CTLA-4]_H0.113_L0_Fab Light Chain

SEQ ID NO: 8731 - protein, 108 aa, Artificial Sequence; identical to SEQ ID NO: 3741
  Description of Artificial Sequence: Synthetic polypeptide
  VL of XENP019327

SEQ ID NO: 8732 - protein, 12 aa, Artificial Sequence
  Description of Artificial Sequence: Synthetic peptide
  XENP019327 vlCDR1
RASQSVGSSYLA

SEQ ID NO: 8733 - protein, 7 aa, Artificial Sequence
  Description of Artificial Sequence: Synthetic peptide
  XENP019327 vlCDR2
GAFSRAT

SEQ ID NO: 8734 - protein, 9 aa, Artificial Sequence
  Description of Artificial Sequence: Synthetic peptide
  XENP019327 vlCDR3
QQYGSSPWT

SEQ ID NO: 8735 - protein, 221 aa, Artificial Sequence
  Description of Artificial Sequence: Synthetic polypeptide
  XENP019328 [CTLA-4]_H0.114_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8736 - protein, 118 aa, Artificial Sequence; identical to SEQ ID NO: 5886
  Description of Artificial Sequence: Synthetic polypeptide
  VH of XENP019328

SEQ ID NO: 8737 - protein, 5 aa, Artificial Sequence
  Description of Artificial Sequence: Synthetic peptide
  XENP019328 vhCDR1
SYTMH

SEQ ID NO: 8738 - protein, 17 aa, Artificial Sequence
  Description of Artificial Sequence: Synthetic peptide
  XENP019328 vhCDR2
FISYDGNNKYYADSVKG

SEQ ID NO: 8739 - protein, 9 aa, Artificial Sequence
  Description of Artificial Sequence: Synthetic peptide
  XENP019328 vhCDR3
TGLLGPFDY

SEQ ID NO: 8740 - protein, 215 aa, Artificial Sequence; identical to SEQ ID NO: 7600
  Description of Artificial Sequence: Synthetic polypeptide
  XENP019328 [CTLA-4]_H0.114_L0_Fab Light Chain

SEQ ID NO: 8741 - protein, 108 aa, Artificial Sequence; identical to SEQ ID NO: 3741
  Description of Artificial Sequence: Synthetic polypeptide
  VL of XENP019328

SEQ ID NO: 8742 - protein, 12 aa, Artificial Sequence
  Description of Artificial Sequence: Synthetic peptide
  XENP019328 vlCDR1
RASQSVGSSYLA

SEQ ID NO: 8743 - protein, 7 aa, Artificial Sequence
  Description of Artificial Sequence: Synthetic peptide
  XENP019328 vlCDR2
GAFSRAT

SEQ ID NO: 8744 - protein, 9 aa, Artificial Sequence
  Description of Artificial Sequence: Synthetic peptide
  XENP019328 vlCDR3
QQYGSSPWT

SEQ ID NO: 8745 - protein, 221 aa, Artificial Sequence
  Description of Artificial Sequence: Synthetic polypeptide
  XENP019329 [CTLA-4]_H0.115_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8746 - protein, 118 aa, Artificial Sequence; identical to SEQ ID NO: 5895
  Description of Artificial Sequence: Synthetic polypeptide
  VH of XENP019329

SEQ ID NO: 8747 - protein, 5 aa, Artificial Sequence
  Description of Artificial Sequence: Synthetic peptide
  XENP019329 vhCDR1
SYTMH

SEQ ID NO: 8748 - protein, 17 aa, Artificial Sequence
  Description of Artificial Sequence: Synthetic peptide
  XENP019329 vhCDR2
FISYDGNNKYYADSVKG

SEQ ID NO: 8749 - protein, 9 aa, Artificial Sequence
  Description of Artificial Sequence: Synthetic peptide
  XENP019329 vhCDR3
TGYLGPFDY

SEQ ID NO: 8750 - protein, 215 aa, Artificial Sequence; identical to SEQ ID NO: 7600
  Description of Artificial Sequence: Synthetic polypeptide
  XENP019329 [CTLA-4]_H0.115_L0_Fab Light Chain

SEQ ID NO: 8751 - protein, 108 aa, Artificial Sequence; identical to SEQ ID NO: 3741
  Description of Artificial Sequence: Synthetic polypeptide
  VL of XENP019329

SEQ ID NO: 8752 - protein, 12 aa, Artificial Sequence
  Description of Artificial Sequence: Synthetic peptide
  XENP019329 vlCDR1
RASQSVGSSYLA

SEQ ID NO: 8753 - protein, 7 aa, Artificial Sequence
  Description of Artificial Sequence: Synthetic peptide
  XENP019329 vlCDR2
GAFSRAT

SEQ ID NO: 8754 - protein, 9 aa, Artificial Sequence
  Description of Artificial Sequence: Synthetic peptide
  XENP019329 vlCDR3
QQYGSSPWT

SEQ ID NO: 8755 - protein, 221 aa, Artificial Sequence
  Description of Artificial Sequence: Synthetic polypeptide
  XENP019330 [CTLA-4]_H0.116_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8756 - protein, 118 aa, Artificial Sequence; identical to SEQ ID NO: 5904
  Description of Artificial Sequence: Synthetic polypeptide
  VH of XENP019330

SEQ ID NO: 8757 - protein, 5 aa, Artificial Sequence
  Description of Artificial Sequence: Synthetic peptide
  XENP019330 vhCDR1
SYTMH

SEQ ID NO: 8758 - protein, 17 aa, Artificial Sequence
  Description of Artificial Sequence: Synthetic peptide
  XENP019330 vhCDR2
FISYDGNNKYYADSVKG

SEQ ID NO: 8759 - protein, 9 aa, Artificial Sequence
  Description of Artificial Sequence: Synthetic peptide
  XENP019330 vhCDR3
TGWDGPFDY

SEQ ID NO: 8760 - protein, 215 aa, Artificial Sequence; identical to SEQ ID NO: 7600
  Description of Artificial Sequence: Synthetic polypeptide
  XENP019330 [CTLA-4]_H0.116_L0_Fab Light Chain

SEQ ID NO: 8761 - protein, 108 aa, Artificial Sequence; identical to SEQ ID NO: 3741
  Description of Artificial Sequence: Synthetic polypeptide
  VL of XENP019330

SEQ ID NO: 8762 - protein, 12 aa, Artificial Sequence
  Description of Artificial Sequence: Synthetic peptide
  XENP019330 vlCDR1
RASQSVGSSYLA

SEQ ID NO: 8763 - protein, 7 aa, Artificial Sequence
  Description of Artificial Sequence: Synthetic peptide
  XENP019330 vlCDR2
GAFSRAT

SEQ ID NO: 8764 - protein, 9 aa, Artificial Sequence
  Description of Artificial Sequence: Synthetic peptide
  XENP019330 vlCDR3
QQYGSSPWT

SEQ ID NO: 8765 - protein, 221 aa, Artificial Sequence
  Description of Artificial Sequence: Synthetic polypeptide
  XENP019331 [CTLA-4]_H0.117_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8766 - protein, 118 aa, Artificial Sequence; identical to SEQ ID NO: 5913
  Description of Artificial Sequence: Synthetic polypeptide
  VH of XENP019331

SEQ ID NO: 8767 - protein, 5 aa, Artificial Sequence
  Description of Artificial Sequence: Synthetic peptide
  XENP019331 vhCDR1
SYTMH

SEQ ID NO: 8768 - protein, 17 aa, Artificial Sequence
  Description of Artificial Sequence: Synthetic peptide
  XENP019331 vhCDR2
FISYDGNNKYYADSVKG

SEQ ID NO: 8769 - protein, 9 aa, Artificial Sequence
  Description of Artificial Sequence: Synthetic peptide
  XENP019331 vhCDR3
TGWIGPFDY

SEQ ID NO: 8770 - protein, 215 aa, Artificial Sequence; identical to SEQ ID NO: 7600
  Description of Artificial Sequence: Synthetic polypeptide
  XENP019331 [CTLA-4]_H0.117_L0_Fab Light Chain

SEQ ID NO: 8771 - protein, 108 aa, Artificial Sequence; identical to SEQ ID NO: 3741
  Description of Artificial Sequence: Synthetic polypeptide
  VL of XENP019331

SEQ ID NO: 8772 - protein, 12 aa, Artificial Sequence
  Description of Artificial Sequence: Synthetic peptide
  XENP019331 vlCDR1
RASQSVGSSYLA

SEQ ID NO: 8773 - protein, 7 aa, Artificial Sequence
  Description of Artificial Sequence: Synthetic peptide
  XENP019331 vlCDR2
GAFSRAT

SEQ ID NO: 8774 - protein, 9 aa, Artificial Sequence
  Description of Artificial Sequence: Synthetic peptide
  XENP019331 vlCDR3
QQYGSSPWT

SEQ ID NO: 8775 - protein, 221 aa, Artificial Sequence
  Description of Artificial Sequence: Synthetic polypeptide
  XENP019332 [CTLA-4]_H0.118_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8776 - protein, 118 aa, Artificial Sequence; identical to SEQ ID NO: 5922
  Description of Artificial Sequence: Synthetic polypeptide
  VH of XENP019332

SEQ ID NO: 8777 - protein, 5 aa, Artificial Sequence
  Description of Artificial Sequence: Synthetic peptide
  XENP019332 vhCDR1
SYTMH

SEQ ID NO: 8778 - protein, 17 aa, Artificial Sequence
  Description of Artificial Sequence: Synthetic peptide
  XENP019332 vhCDR2
FISYDGNNKYYADSVKG

SEQ ID NO: 8779 - protein, 9 aa, Artificial Sequence
  Description of Artificial Sequence: Synthetic peptide
  XENP019332 vhCDR3
TGWVGPFDY

SEQ ID NO: 8780 - protein, 215 aa, Artificial Sequence; identical to SEQ ID NO: 7600
  Description of Artificial Sequence: Synthetic polypeptide
  XENP019332 [CTLA-4]_H0.118_L0_Fab Light Chain

SEQ ID NO: 8781 - protein, 108 aa, Artificial Sequence; identical to SEQ ID NO: 3741
  Description of Artificial Sequence: Synthetic polypeptide
  VL of XENP019332

SEQ ID NO: 8782 - protein, 12 aa, Artificial Sequence
  Description of Artificial Sequence: Synthetic peptide
  XENP019332 vlCDR1
RASQSVGSSYLA

SEQ ID NO: 8783 - protein, 7 aa, Artificial Sequence
  Description of Artificial Sequence: Synthetic peptide
  XENP019332 vlCDR2
GAFSRAT

SEQ ID NO: 8784 - protein, 9 aa, Artificial Sequence
  Description of Artificial Sequence: Synthetic peptide
  XENP019332 vlCDR3
QQYGSSPWT

SEQ ID NO: 8785 - protein, 221 aa, Artificial Sequence
  Description of Artificial Sequence: Synthetic polypeptide
  XENP019333 [CTLA-4]_H0.119_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8786 - protein, 118 aa, Artificial Sequence; identical to SEQ ID NO: 5931
  Description of Artificial Sequence: Synthetic polypeptide
  VH of XENP019333

SEQ ID NO: 8787 - protein, 5 aa, Artificial Sequence
  Description of Artificial Sequence: Synthetic peptide
  XENP019333 vhCDR1
SYTMH

SEQ ID NO: 8788 - protein, 17 aa, Artificial Sequence
  Description of Artificial Sequence: Synthetic peptide
  XENP019333 vhCDR2
FISYDGNNKYYADSVKG

SEQ ID NO: 8789 - protein, 9 aa, Artificial Sequence
  Description of Artificial Sequence: Synthetic peptide
  XENP019333 vhCDR3
TGWLAPFDY

SEQ ID NO: 8790 - protein, 215 aa, Artificial Sequence; identical to SEQ ID NO: 7600
  Description of Artificial Sequence: Synthetic polypeptide
  XENP019333 [CTLA-4]_H0.119_L0_Fab Light Chain

SEQ ID NO: 8791 - protein, 108 aa, Artificial Sequence; identical to SEQ ID NO: 3741
  Description of Artificial Sequence: Synthetic polypeptide
  VL of XENP019333

SEQ ID NO: 8792 - protein, 12 aa, Artificial Sequence
  Description of Artificial Sequence: Synthetic peptide
  XENP019333 vlCDR1
RASQSVGSSYLA

SEQ ID NO: 8793 - protein, 7 aa, Artificial Sequence
  Description of Artificial Sequence: Synthetic peptide
  XENP019333 vlCDR2
GAFSRAT

SEQ ID NO: 8794 - protein, 9 aa, Artificial Sequence
  Description of Artificial Sequence: Synthetic peptide
  XENP019333 vlCDR3
QQYGSSPWT

SEQ ID NO: 8795 - protein, 221 aa, Artificial Sequence
  Description of Artificial Sequence: Synthetic polypeptide
  XENP019334 [CTLA-4]_H0.120_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8796 - protein, 118 aa, Artificial Sequence; identical to SEQ ID NO: 5940
  Description of Artificial Sequence: Synthetic polypeptide
  VH of XENP019334

SEQ ID NO: 8797 - protein, 5 aa, Artificial Sequence
  Description of Artificial Sequence: Synthetic peptide
  XENP019334 vhCDR1
SYTMH

SEQ ID NO: 8798 - protein, 17 aa, Artificial Sequence
  Description of Artificial Sequence: Synthetic peptide
  XENP019334 vhCDR2
FISYDGNNKYYADSVKG

SEQ ID NO: 8799 - protein, 9 aa, Artificial Sequence
  Description of Artificial Sequence: Synthetic peptide
  XENP019334 vhCDR3
TGWLSPFDY

SEQ ID NO: 8800 - protein, 215 aa, Artificial Sequence; identical to SEQ ID NO: 7600
  Description of Artificial Sequence: Synthetic polypeptide
  XENP019334 [CTLA-4]_H0.120_L0_Fab Light Chain

SEQ ID NO: 8801 - protein, 108 aa, Artificial Sequence; identical to SEQ ID NO: 3741
  Description of Artificial Sequence: Synthetic polypeptide
  VL of XENP019334

SEQ ID NO: 8802 - protein, 12 aa, Artificial Sequence
  Description of Artificial Sequence: Synthetic peptide
  XENP019334 vlCDR1
RASQSVGSSYLA

SEQ ID NO: 8803 - protein, 7 aa, Artificial Sequence
  Description of Artificial Sequence: Synthetic peptide
  XENP019334 vlCDR2
GAFSRAT

SEQ ID NO: 8804 - protein, 9 aa, Artificial Sequence
  Description of Artificial Sequence: Synthetic peptide
  XENP019334 vlCDR3
QQYGSSPWT

SEQ ID NO: 8805 - protein, 221 aa, Artificial Sequence
  Description of Artificial Sequence: Synthetic polypeptide
  XENP019335 [CTLA-4]_H0.121_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8806 - protein, 118 aa, Artificial Sequence; identical to SEQ ID NO: 5949
  Description of Artificial Sequence: Synthetic polypeptide
  VH of XENP019335

SEQ ID NO: 8807 - protein, 5 aa, Artificial Sequence
  Description of Artificial Sequence: Synthetic peptide
  XENP019335 vhCDR1
SYTMH

SEQ ID NO: 8808 - protein, 17 aa, Artificial Sequence
  Description of Artificial Sequence: Synthetic peptide
  XENP019335 vhCDR2
FISYDGNNKYYADSVKG

SEQ ID NO: 8809 - protein, 9 aa, Artificial Sequence
  Description of Artificial Sequence: Synthetic peptide
  XENP019335 vhCDR3
TGWLTPFDY

SEQ ID NO: 8810 - protein, 215 aa, Artificial Sequence; identical to SEQ ID NO: 7600
  Description of Artificial Sequence: Synthetic polypeptide
  XENP019335 [CTLA-4]_H0.121_L0_Fab Light Chain

SEQ ID NO: 8811 - protein, 108 aa, Artificial Sequence; identical to SEQ ID NO: 3741
  Description of Artificial Sequence: Synthetic polypeptide
  VL of XENP019335

SEQ ID NO: 8812 - protein, 12 aa, Artificial Sequence
  Description of Artificial Sequence: Synthetic peptide
  XENP019335 vlCDR1
RASQSVGSSYLA

SEQ ID NO: 8813 - protein, 7 aa, Artificial Sequence
  Description of Artificial Sequence: Synthetic peptide
  XENP019335 vlCDR2
GAFSRAT

SEQ ID NO: 8814 - protein, 9 aa, Artificial Sequence
  Description of Artificial Sequence: Synthetic peptide
  XENP019335 vlCDR3
QQYGSSPWT

SEQ ID NO: 8815 - protein, 221 aa, Artificial Sequence
  Description of Artificial Sequence: Synthetic polypeptide
  XENP019336 [CTLA-4]_H0.122_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8816 - protein, 118 aa, Artificial Sequence; identical to SEQ ID NO: 5958
  Description of Artificial Sequence: Synthetic polypeptide
  VH of XENP019336

SEQ ID NO: 8817 - protein, 5 aa, Artificial Sequence
  Description of Artificial Sequence: Synthetic peptide
  XENP019336 vhCDR1
SYTMH

SEQ ID NO: 8818 - protein, 17 aa, Artificial Sequence
  Description of Artificial Sequence: Synthetic peptide
  XENP019336 vhCDR2
FISYDGNNKYYADSVKG

SEQ ID NO: 8819 - protein, 9 aa, Artificial Sequence
  Description of Artificial Sequence: Synthetic peptide
  XENP019336 vhCDR3
TGWLGPLDY

SEQ ID NO: 8820 - protein, 215 aa, Artificial Sequence; identical to SEQ ID NO: 7600
  Description of Artificial Sequence: Synthetic polypeptide
  XENP019336 [CTLA-4]_H0.122_L0_Fab Light Chain

SEQ ID NO: 8821 - protein, 108 aa, Artificial Sequence; identical to SEQ ID NO: 3741
  Description of Artificial Sequence: Synthetic polypeptide
  VL of XENP019336

SEQ ID NO: 8822 - protein, 12 aa, Artificial Sequence
  Description of Artificial Sequence: Synthetic peptide
  XENP019336 vlCDR1
RASQSVGSSYLA

SEQ ID NO: 8823 - protein, 7 aa, Artificial Sequence
  Description of Artificial Sequence: Synthetic peptide
  XENP019336 vlCDR2
GAFSRAT

SEQ ID NO: 8824 - protein, 9 aa, Artificial Sequence
  Description of Artificial Sequence: Synthetic peptide
  XENP019336 vlCDR3
QQYGSSPWT

SEQ ID NO: 8825 - protein, 221 aa, Artificial Sequence
  Description of Artificial Sequence: Synthetic polypeptide
  XENP019337 [CTLA-4]_H0.123_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8826 - protein, 118 aa, Artificial Sequence; identical to SEQ ID NO: 5967
  Description of Artificial Sequence: Synthetic polypeptide
  VH of XENP019337

SEQ ID NO: 8827 - protein, 5 aa, Artificial Sequence
  Description of Artificial Sequence: Synthetic peptide
  XENP019337 vhCDR1
SYTMH

SEQ ID NO: 8828 - protein, 17 aa, Artificial Sequence
  Description of Artificial Sequence: Synthetic peptide
  XENP019337 vhCDR2
FISYDGNNKYYADSVKG

SEQ ID NO: 8829 - protein, 9 aa, Artificial Sequence
  Description of Artificial Sequence: Synthetic peptide
  XENP019337 vhCDR3
TGWLGPMDY

SEQ ID NO: 8830 - protein, 215 aa, Artificial Sequence; identical to SEQ ID NO: 7600
  Description of Artificial Sequence: Synthetic polypeptide
  XENP019337 [CTLA-4]_H0.123_L0_Fab Light Chain

SEQ ID NO: 8831 - protein, 108 aa, Artificial Sequence; identical to SEQ ID NO: 3741
  Description of Artificial Sequence: Synthetic polypeptide
  VL of XENP019337

SEQ ID NO: 8832 - protein, 12 aa, Artificial Sequence
  Description of Artificial Sequence: Synthetic peptide
  XENP019337 vlCDR1
RASQSVGSSYLA

SEQ ID NO: 8833 - protein, 7 aa, Artificial Sequence
  Description of Artificial Sequence: Synthetic peptide
  XENP019337 vlCDR2
GAFSRAT

SEQ ID NO: 8834 - protein, 9 aa, Artificial Sequence
  Description of Artificial Sequence: Synthetic peptide
  XENP019337 vlCDR3
QQYGSSPWT

SEQ ID NO: 8835 - protein, 221 aa, Artificial Sequence
  Description of Artificial Sequence: Synthetic polypeptide
  XENP019338 [CTLA-4]_H0.124_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8836 - protein, 118 aa, Artificial Sequence; identical to SEQ ID NO: 5976
  Description of Artificial Sequence: Synthetic polypeptide
  VH of XENP019338

SEQ ID NO: 8837 - protein, 5 aa, Artificial Sequence
  Description of Artificial Sequence: Synthetic peptide
  XENP019338 vhCDR1
SYTMH

SEQ ID NO: 8838 - protein, 17 aa, Artificial Sequence
  Description of Artificial Sequence: Synthetic peptide
  XENP019338 vhCDR2
FISYDGNNKYYADSVKG

SEQ ID NO: 8839 - protein, 9 aa, Artificial Sequence
  Description of Artificial Sequence: Synthetic peptide
  XENP019338 vhCDR3
TGWLGPFAY

SEQ ID NO: 8840 - protein, 215 aa, Artificial Sequence; identical to SEQ ID NO: 7600
  Description of Artificial Sequence: Synthetic polypeptide
  XENP019338 [CTLA-4]_H0.124_L0_Fab Light Chain

SEQ ID NO: 8841 - protein, 108 aa, Artificial Sequence; identical to SEQ ID NO: 3741
  Description of Artificial Sequence: Synthetic polypeptide
  VL of XENP019338

SEQ ID NO: 8842 - protein, 12 aa, Artificial Sequence
  Description of Artificial Sequence: Synthetic peptide
  XENP019338 vlCDR1
RASQSVGSSYLA

SEQ ID NO: 8843 - protein, 7 aa, Artificial Sequence
  Description of Artificial Sequence: Synthetic peptide
  XENP019338 vlCDR2
GAFSRAT

SEQ ID NO: 8844 - protein, 9 aa, Artificial Sequence
  Description of Artificial Sequence: Synthetic peptide
  XENP019338 vlCDR3
QQYGSSPWT

SEQ ID NO: 8845 - protein, 221 aa, Artificial Sequence
  Description of Artificial Sequence: Synthetic polypeptide
  XENP019339 [CTLA-4]_H0.125_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8846 - protein, 118 aa, Artificial Sequence; identical to SEQ ID NO: 5985
  Description of Artificial Sequence: Synthetic polypeptide
  VH of XENP019339

SEQ ID NO: 8847 - protein, 5 aa, Artificial Sequence
  Description of Artificial Sequence: Synthetic peptide
  XENP019339 vhCDR1
SYTMH

SEQ ID NO: 8848 - protein, 17 aa, Artificial Sequence
  Description of Artificial Sequence: Synthetic peptide
  XENP019339 vhCDR2
FISYDGNNKYYADSVKG

SEQ ID NO: 8849 - protein, 9 aa, Artificial Sequence
  Description of Artificial Sequence: Synthetic peptide
  XENP019339 vhCDR3
TGWLGPFEY

SEQ ID NO: 8850 - protein, 215 aa, Artificial Sequence; identical to SEQ ID NO: 7600
  Description of Artificial Sequence: Synthetic polypeptide
  XENP019339 [CTLA-4]_H0.125_L0_Fab Light Chain

SEQ ID NO: 8851 - protein, 108 aa, Artificial Sequence; identical to SEQ ID NO: 3741
  Description of Artificial Sequence: Synthetic polypeptide
  VL of XENP019339

SEQ ID NO: 8852 - protein, 12 aa, Artificial Sequence
  Description of Artificial Sequence: Synthetic peptide
  XENP019339 vlCDR1
RASQSVGSSYLA

SEQ ID NO: 8853 - protein, 7 aa, Artificial Sequence
  Description of Artificial Sequence: Synthetic peptide
  XENP019339 vlCDR2
GAFSRAT

SEQ ID NO: 8854 - protein, 9 aa, Artificial Sequence
  Description of Artificial Sequence: Synthetic peptide
  XENP019339 vlCDR3
QQYGSSPWT

SEQ ID NO: 8855 - protein, 221 aa, Artificial Sequence
  Description of Artificial Sequence: Synthetic polypeptide
  XENP019340 [CTLA-4]_H0.126_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8856 - protein, 118 aa, Artificial Sequence; identical to SEQ ID NO: 5994
  Description of Artificial Sequence: Synthetic polypeptide
  VH of XENP019340

SEQ ID NO: 8857 - protein, 5 aa, Artificial Sequence
  Description of Artificial Sequence: Synthetic peptide
  XENP019340 vhCDR1
SYTMH

SEQ ID NO: 8858 - protein, 17 aa, Artificial Sequence
  Description of Artificial Sequence: Synthetic peptide
  XENP019340 vhCDR2
FISYDGNNKYYADSVKG

SEQ ID NO: 8859 - protein, 9 aa, Artificial Sequence
  Description of Artificial Sequence: Synthetic peptide
  XENP019340 vhCDR3
TGWLGPFHY

SEQ ID NO: 8860 - protein, 215 aa, Artificial Sequence; identical to SEQ ID NO: 7600
  Description of Artificial Sequence: Synthetic polypeptide
  XENP019340 [CTLA-4]_H0.126_L0_Fab Light Chain

SEQ ID NO: 8861 - protein, 108 aa, Artificial Sequence; identical to SEQ ID NO: 3741
  Description of Artificial Sequence: Synthetic polypeptide
  VL of XENP019340

SEQ ID NO: 8862 - protein, 12 aa, Artificial Sequence
  Description of Artificial Sequence: Synthetic peptide
  XENP019340 vlCDR1
RASQSVGSSYLA

SEQ ID NO: 8863 - protein, 7 aa, Artificial Sequence
  Description of Artificial Sequence: Synthetic peptide
  XENP019340 vlCDR2
GAFSRAT

SEQ ID NO: 8864 - protein, 9 aa, Artificial Sequence
  Description of Artificial Sequence: Synthetic peptide
  XENP019340 vlCDR3
QQYGSSPWT

SEQ ID NO: 8865 - protein, 221 aa, Artificial Sequence
  Description of Artificial Sequence: Synthetic polypeptide
  XENP019341 [CTLA-4]_H0.127_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8866 - protein, 118 aa, Artificial Sequence; identical to SEQ ID NO: 6003
  Description of Artificial Sequence: Synthetic polypeptide
  VH of XENP019341

SEQ ID NO: 8867 - protein, 5 aa, Artificial Sequence
  Description of Artificial Sequence: Synthetic peptide
  XENP019341 vhCDR1
SYTMH

SEQ ID NO: 8868 - protein, 17 aa, Artificial Sequence
  Description of Artificial Sequence: Synthetic peptide
  XENP019341 vhCDR2
FISYDGNNKYYADSVKG

SEQ ID NO: 8869 - protein, 9 aa, Artificial Sequence
  Description of Artificial Sequence: Synthetic peptide
  XENP019341 vhCDR3
TGWLGPFNY

SEQ ID NO: 8870 - protein, 215 aa, Artificial Sequence; identical to SEQ ID NO: 7600
  Description of Artificial Sequence: Synthetic polypeptide
  XENP019341 [CTLA-4]_H0.127_L0_Fab Light Chain

SEQ ID NO: 8871 - protein, 108 aa, Artificial Sequence; identical to SEQ ID NO: 3741
  Description of Artificial Sequence: Synthetic polypeptide
  VL of XENP019341

SEQ ID NO: 8872 - protein, 12 aa, Artificial Sequence
  Description of Artificial Sequence: Synthetic peptide
  XENP019341 vlCDR1
RASQSVGSSYLA

SEQ ID NO: 8873 - protein, 7 aa, Artificial Sequence
  Description of Artificial Sequence: Synthetic peptide
  XENP019341 vlCDR2
GAFSRAT

SEQ ID NO: 8874 - protein, 9 aa, Artificial Sequence
  Description of Artificial Sequence: Synthetic peptide
  XENP019341 vlCDR3
QQYGSSPWT

SEQ ID NO: 8875 - protein, 221 aa, Artificial Sequence
  Description of Artificial Sequence: Synthetic polypeptide
  XENP019342 [CTLA-4]_H0.128_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8876 - protein, 118 aa, Artificial Sequence; identical to SEQ ID NO: 6012
  Description of Artificial Sequence: Synthetic polypeptide
  VH of XENP019342

SEQ ID NO: 8877 - protein, 5 aa, Artificial Sequence
  Description of Artificial Sequence: Synthetic peptide
  XENP019342 vhCDR1
SYTMH

SEQ ID NO: 8878 - protein, 17 aa, Artificial Sequence
  Description of Artificial Sequence: Synthetic peptide
  XENP019342 vhCDR2
FISYDGNNKYYADSVKG

SEQ ID NO: 8879 - protein, 9 aa, Artificial Sequence
  Description of Artificial Sequence: Synthetic peptide
  XENP019342 vhCDR3
TGWLGPFSY

SEQ ID NO: 8880 - protein, 215 aa, Artificial Sequence; identical to SEQ ID NO: 7600
  Description of Artificial Sequence: Synthetic polypeptide
  XENP019342 [CTLA-4]_H0.128_L0_Fab Light Chain

SEQ ID NO: 8881 - protein, 108 aa, Artificial Sequence; identical to SEQ ID NO: 3741
  Description of Artificial Sequence: Synthetic polypeptide
  VL of XENP019342

SEQ ID NO: 8882 - protein, 12 aa, Artificial Sequence
  Description of Artificial Sequence: Synthetic peptide
  XENP019342 vlCDR1
RASQSVGSSYLA

SEQ ID NO: 8883 - protein, 7 aa, Artificial Sequence
  Description of Artificial Sequence: Synthetic peptide
  XENP019342 vlCDR2
GAFSRAT

SEQ ID NO: 8884 - protein, 9 aa, Artificial Sequence
  Description of Artificial Sequence: Synthetic peptide
  XENP019342 vlCDR3
QQYGSSPWT

SEQ ID NO: 8885 - protein, 221 aa, Artificial Sequence
  Description of Artificial Sequence: Synthetic polypeptide
  XENP019343 [CTLA-4]_H0.129_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8886 - protein, 118 aa, Artificial Sequence; identical to SEQ ID NO: 6021
  Description of Artificial Sequence: Synthetic polypeptide
  VH of XENP019343

SEQ ID NO: 8887 - protein, 5 aa, Artificial Sequence
  Description of Artificial Sequence: Synthetic peptide
  XENP019343 vhCDR1
SYTMH

SEQ ID NO: 8888 - protein, 17 aa, Artificial Sequence
  Description of Artificial Sequence: Synthetic peptide
  XENP019343 vhCDR2
FISYDGNNKYYADSVKG

SEQ ID NO: 8889 - protein, 9 aa, Artificial Sequence
  Description of Artificial Sequence: Synthetic peptide
  XENP019343 vhCDR3
TGWLGPFQY

SEQ ID NO: 8890 - protein, 215 aa, Artificial Sequence; identical to SEQ ID NO: 7600
  Description of Artificial Sequence: Synthetic polypeptide
  XENP019343 [CTLA-4]_H0.129_L0_Fab Light Chain

SEQ ID NO: 8891 - protein, 108 aa, Artificial Sequence; identical to SEQ ID NO: 3741
  Description of Artificial Sequence: Synthetic polypeptide
  VL of XENP019343

SEQ ID NO: 8892 - protein, 12 aa, Artificial Sequence
  Description of Artificial Sequence: Synthetic peptide
  XENP019343 vlCDR1
RASQSVGSSYLA

SEQ ID NO: 8893 - protein, 7 aa, Artificial Sequence
  Description of Artificial Sequence: Synthetic peptide
  XENP019343 vlCDR2
GAFSRAT

SEQ ID NO: 8894 - protein, 9 aa, Artificial Sequence
  Description of Artificial Sequence: Synthetic peptide
  XENP019343 vlCDR3
QQYGSSPWT

SEQ ID NO: 8895 - protein, 221 aa, Artificial Sequence
  Description of Artificial Sequence: Synthetic polypeptide
  XENP019344 [CTLA-4]_H0.130_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8896 - protein, 118 aa, Artificial Sequence; identical to SEQ ID NO: 6030
  Description of Artificial Sequence: Synthetic polypeptide
  VH of XENP019344

SEQ ID NO: 8897 - protein, 5 aa, Artificial Sequence
  Description of Artificial Sequence: Synthetic peptide
  XENP019344 vhCDR1
SYTMH

SEQ ID NO: 8898 - protein, 17 aa, Artificial Sequence
  Description of Artificial Sequence: Synthetic peptide
  XENP019344 vhCDR2
FISYDGNNKYYADSVKG

SEQ ID NO: 8899 - protein, 9 aa, Artificial Sequence
  Description of Artificial Sequence: Synthetic peptide
  XENP019344 vhCDR3
TGWLGPFDH

SEQ ID NO: 8900 - protein, 215 aa, Artificial Sequence; identical to SEQ ID NO: 7600
  Description of Artificial Sequence: Synthetic polypeptide
  XENP019344 [CTLA-4]_H0.130_L0_Fab Light Chain

SEQ ID NO: 8901 - protein, 108 aa, Artificial Sequence; identical to SEQ ID NO: 3741
  Description of Artificial Sequence: Synthetic polypeptide
  VL of XENP019344

SEQ ID NO: 8902 - protein, 12 aa, Artificial Sequence
  Description of Artificial Sequence: Synthetic peptide
  XENP019344 vlCDR1
RASQSVGSSYLA

SEQ ID NO: 8903 - protein, 7 aa, Artificial Sequence
  Description of Artificial Sequence: Synthetic peptide
  XENP019344 vlCDR2
GAFSRAT

SEQ ID NO: 8904 - protein, 9 aa, Artificial Sequence
  Description of Artificial Sequence: Synthetic peptide
  XENP019344 vlCDR3
QQYGSSPWT

SEQ ID NO: 8905 - protein, 221 aa, Artificial Sequence
  Description of Artificial Sequence: Synthetic polypeptide
  XENP019345 [CTLA-4]_H0.131_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8906 - protein, 118 aa, Artificial Sequence; identical to SEQ ID NO: 6039
  Description of Artificial Sequence: Synthetic polypeptide
  VH of XENP019345

SEQ ID NO: 8907 - protein, 5 aa, Artificial Sequence
  Description of Artificial Sequence: Synthetic peptide
  XENP019345 vhCDR1
SYTMH

SEQ ID NO: 8908 - protein, 17 aa, Artificial Sequence
  Description of Artificial Sequence: Synthetic peptide
  XENP019345 vhCDR2
FISYDGNNKYYADSVKG

SEQ ID NO: 8909 - protein, 9 aa, Artificial Sequence
  Description of Artificial Sequence: Synthetic peptide
  XENP019345 vhCDR3
TGWLGPFDL

SEQ ID NO: 8910 - protein, 215 aa, Artificial Sequence; identical to SEQ ID NO: 7600
  Description of Artificial Sequence: Synthetic polypeptide
  XENP019345 [CTLA-4]_H0.131_L0_Fab Light Chain

SEQ ID NO: 8911 - protein, 108 aa, Artificial Sequence; identical to SEQ ID NO: 3741
  Description of Artificial Sequence: Synthetic polypeptide
  VL of XENP019345

SEQ ID NO: 8912 - protein, 12 aa, Artificial Sequence
  Description of Artificial Sequence: Synthetic peptide
  XENP019345 vlCDR1
RASQSVGSSYLA

SEQ ID NO: 8913 - protein, 7 aa, Artificial Sequence
  Description of Artificial Sequence: Synthetic peptide
  XENP019345 vlCDR2
GAFSRAT

SEQ ID NO: 8914 - protein, 9 aa, Artificial Sequence
  Description of Artificial Sequence: Synthetic peptide
  XENP019345 vlCDR3
QQYGSSPWT

SEQ ID NO: 8915 - protein, 221 aa, Artificial Sequence
  Description of Artificial Sequence: Synthetic polypeptide
  XENP019346 [CTLA-4]_H0.132_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8916 - protein, 118 aa, Artificial Sequence; identical to SEQ ID NO: 6048
  Description of Artificial Sequence: Synthetic polypeptide
  VH of XENP019346

SEQ ID NO: 8917 - protein, 5 aa, Artificial Sequence
  Description of Artificial Sequence: Synthetic peptide
  XENP019346 vhCDR1
SYTMH

SEQ ID NO: 8918 - protein, 17 aa, Artificial Sequence
  Description of Artificial Sequence: Synthetic peptide
  XENP019346 vhCDR2
FISYDGNNKYYADSVKG

SEQ ID NO: 8919 - protein, 9 aa, Artificial Sequence
  Description of Artificial Sequence: Synthetic peptide
  XENP019346 vhCDR3
TGWLGPFDS

SEQ ID NO: 8920 - protein, 215 aa, Artificial Sequence; identical to SEQ ID NO: 7600
  Description of Artificial Sequence: Synthetic polypeptide
  XENP019346 [CTLA-4]_H0.132_L0_Fab Light Chain

SEQ ID NO: 8921 - protein, 108 aa, Artificial Sequence; identical to SEQ ID NO: 3741
  Description of Artificial Sequence: Synthetic polypeptide
  VL of XENP019346

SEQ ID NO: 8922 - protein, 12 aa, Artificial Sequence
  Description of Artificial Sequence: Synthetic peptide
  XENP019346 vlCDR1
RASQSVGSSYLA

SEQ ID NO: 8923 - protein, 7 aa, Artificial Sequence
  Description of Artificial Sequence: Synthetic peptide
  XENP019346 vlCDR2
GAFSRAT

SEQ ID NO: 8924 - protein, 9 aa, Artificial Sequence
  Description of Artificial Sequence: Synthetic peptide
  XENP019346 vlCDR3
QQYGSSPWT

SEQ ID NO: 8925 - protein, 221 aa, Artificial Sequence
  Description of Artificial Sequence: Synthetic polypeptide
  XENP019347 [CTLA-4]_H0.133_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8926 - protein, 118 aa, Artificial Sequence; identical to SEQ ID NO: 6057
  Description of Artificial Sequence: Synthetic polypeptide
  VH of XENP019347

SEQ ID NO: 8927 - protein, 5 aa, Artificial Sequence
  Description of Artificial Sequence: Synthetic peptide
  XENP019347 vhCDR1
SYTMH

SEQ ID NO: 8928 - protein, 17 aa, Artificial Sequence
  Description of Artificial Sequence: Synthetic peptide
  XENP019347 vhCDR2
FISYDGNNKYYADSVKG

SEQ ID NO: 8929 - protein, 9 aa, Artificial Sequence
  Description of Artificial Sequence: Synthetic peptide
  XENP019347 vhCDR3
TGWLGPFDV

SEQ ID NO: 8930 - protein, 215 aa, Artificial Sequence; identical to SEQ ID NO: 7600
  Description of Artificial Sequence: Synthetic polypeptide
  XENP019347 [CTLA-4]_H0.133_L0_Fab Light Chain

SEQ ID NO: 8931 - protein, 108 aa, Artificial Sequence; identical to SEQ ID NO: 3741
  Description of Artificial Sequence: Synthetic polypeptide
  VL of XENP019347

SEQ ID NO: 8932 - protein, 12 aa, Artificial Sequence
  Description of Artificial Sequence: Synthetic peptide
  XENP019347 vlCDR1
RASQSVGSSYLA

SEQ ID NO: 8933 - protein, 7 aa, Artificial Sequence
  Description of Artificial Sequence: Synthetic peptide
  XENP019347 vlCDR2
GAFSRAT

SEQ ID NO: 8934 - protein, 9 aa, Artificial Sequence
  Description of Artificial Sequence: Synthetic peptide
  XENP019347 vlCDR3
QQYGSSPWT

SEQ ID NO: 8935 - protein, 221 aa, Artificial Sequence
  Description of Artificial Sequence: Synthetic polypeptide
  XENP019348 [CTLA-4]_H0.134_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8936 - protein, 118 aa, Artificial Sequence; identical to SEQ ID NO: 4743
  Description of Artificial Sequence: Synthetic polypeptide
  VH of XENP019348

SEQ ID NO: 8937 - protein, 5 aa, Artificial Sequence
  Description of Artificial Sequence: Synthetic peptide
  XENP019348 vhCDR1
SYTMH

SEQ ID NO: 8938 - protein, 17 aa, Artificial Sequence
  Description of Artificial Sequence: Synthetic peptide
  XENP019348 vhCDR2
FISYDGNNKYYADSVKG

SEQ ID NO: 8939 - protein, 9 aa, Artificial Sequence
  Description of Artificial Sequence: Synthetic peptide
  XENP019348 vhCDR3
TGWLGPFDY

SEQ ID NO: 8940 - protein, 215 aa, Artificial Sequence; identical to SEQ ID NO: 7600
  Description of Artificial Sequence: Synthetic polypeptide
  XENP019348 [CTLA-4]_H0.134_L0_Fab Light Chain

SEQ ID NO: 8941 - protein, 108 aa, Artificial Sequence; identical to SEQ ID NO: 3741
  Description of Artificial Sequence: Synthetic polypeptide
  VL of XENP019348

SEQ ID NO: 8942 - protein, 12 aa, Artificial Sequence
  Description of Artificial Sequence: Synthetic peptide
  XENP019348 vlCDR1
RASQSVGSSYLA

SEQ ID NO: 8943 - protein, 7 aa, Artificial Sequence
  Description of Artificial Sequence: Synthetic peptide
  XENP019348 vlCDR2
GAFSRAT

SEQ ID NO: 8944 - protein, 9 aa, Artificial Sequence
  Description of Artificial Sequence: Synthetic peptide
  XENP019348 vlCDR3
QQYGSSPWT

SEQ ID NO: 8945 - protein, 221 aa, Artificial Sequence
  Description of Artificial Sequence: Synthetic polypeptide
  XENP019349 [CTLA-4]_H0.135_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8946 - protein, 118 aa, Artificial Sequence; identical to SEQ ID NO: 6075
  Description of Artificial Sequence: Synthetic polypeptide
  VH of XENP019349

SEQ ID NO: 8947 - protein, 5 aa, Artificial Sequence
  Description of Artificial Sequence: Synthetic peptide
  XENP019349 vhCDR1
SYTMH

SEQ ID NO: 8948 - protein, 17 aa, Artificial Sequence
  Description of Artificial Sequence: Synthetic peptide
  XENP019349 vhCDR2
FISYDGNNKYYADSVKG

SEQ ID NO: 8949 - protein, 9 aa, Artificial Sequence
  Description of Artificial Sequence: Synthetic peptide
  XENP019349 vhCDR3
TGWLGPFDY

SEQ ID NO: 8950 - protein, 215 aa, Artificial Sequence; identical to SEQ ID NO: 7600
  Description of Artificial Sequence: Synthetic polypeptide
  XENP019349 [CTLA-4]_H0.135_L0_Fab Light Chain

SEQ ID NO: 8951 - protein, 108 aa, Artificial Sequence; identical to SEQ ID NO: 3741
  Description of Artificial Sequence: Synthetic polypeptide
  VL of XENP019349

SEQ ID NO: 8952 - protein, 12 aa, Artificial Sequence
  Description of Artificial Sequence: Synthetic peptide
  XENP019349 vlCDR1
RASQSVGSSYLA

SEQ ID NO: 8953 - protein, 7 aa, Artificial Sequence
  Description of Artificial Sequence: Synthetic peptide
  XENP019349 vlCDR2
GAFSRAT

SEQ ID NO: 8954 - protein, 9 aa, Artificial Sequence
  Description of Artificial Sequence: Synthetic peptide
  XENP019349 vlCDR3
QQYGSSPWT

SEQ ID NO: 8955 - protein, 221 aa, Artificial Sequence
  Description of Artificial Sequence: Synthetic polypeptide
  XENP019350 [CTLA-4]_H0.136_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8956 - protein, 118 aa, Artificial Sequence; identical to SEQ ID NO: 6084
  Description of Artificial Sequence: Synthetic polypeptide
  VH of XENP019350

SEQ ID NO: 8957 - protein, 5 aa, Artificial Sequence
  Description of Artificial Sequence: Synthetic peptide
  XENP019350 vhCDR1
SYTMH

SEQ ID NO: 8958 - protein, 17 aa, Artificial Sequence
  Description of Artificial Sequence: Synthetic peptide
  XENP019350 vhCDR2
FISYDGNNKYYADSVKG

SEQ ID NO: 8959 - protein, 9 aa, Artificial Sequence
  Description of Artificial Sequence: Synthetic peptide
  XENP019350 vhCDR3
TGWLGPFDY

SEQ ID NO: 8960 - protein, 215 aa, Artificial Sequence; identical to SEQ ID NO: 7600
  Description of Artificial Sequence: Synthetic polypeptide
  XENP019350 [CTLA-4]_H0.136_L0_Fab Light Chain

SEQ ID NO: 8961 - protein, 108 aa, Artificial Sequence; identical to SEQ ID NO: 3741
  Description of Artificial Sequence: Synthetic polypeptide
  VL of XENP019350

SEQ ID NO: 8962 - protein, 12 aa, Artificial Sequence
  Description of Artificial Sequence: Synthetic peptide
  XENP019350 vlCDR1
RASQSVGSSYLA

SEQ ID NO: 8963 - protein, 7 aa, Artificial Sequence
  Description of Artificial Sequence: Synthetic peptide
  XENP019350 vlCDR2
GAFSRAT

SEQ ID NO: 8964 - protein, 9 aa, Artificial Sequence
  Description of Artificial Sequence: Synthetic peptide
  XENP019350 vlCDR3
QQYGSSPWT

SEQ ID NO: 8965 - protein, 221 aa, Artificial Sequence; identical to SEQ ID NO: 7595
  Description of Artificial Sequence: Synthetic polypeptide
  XENP019416 [CTLA-4]_H0_L0.1_Fab Heavy Chain

SEQ ID NO: 8966 - protein, 118 aa, Artificial Sequence; identical to SEQ ID NO: 3737
  Description of Artificial Sequence: Synthetic polypeptide
  VH of XENP019416

SEQ ID NO: 8967 - protein, 5 aa, Artificial Sequence
  Description of Artificial Sequence: Synthetic peptide
  XENP019416 vhCDR1
SYTMH

SEQ ID NO: 8968 - protein, 17 aa, Artificial Sequence
  Description of Artificial Sequence: Synthetic peptide
  XENP019416 vhCDR2
FISYDGNNKYYADSVKG

SEQ ID NO: 8969 - protein, 9 aa, Artificial Sequence
  Description of Artificial Sequence: Synthetic peptide
  XENP019416 vhCDR3
TGWLGPFDY

SEQ ID NO: 8970 - protein, 215 aa, Artificial Sequence
  Description of Artificial Sequence: Synthetic polypeptide
  XENP019416 [CTLA-4]_H0_L0.1_Fab Light Chain
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8971 - protein, 108 aa, Artificial Sequence; identical to SEQ ID NO: 6094
  Description of Artificial Sequence: Synthetic polypeptide
  VL of XENP019416

SEQ ID NO: 8972 - protein, 12 aa, Artificial Sequence
  Description of Artificial Sequence: Synthetic peptide
  XENP019416 vlCDR1
RASQSVGSSYLA

SEQ ID NO: 8973 - protein, 7 aa, Artificial Sequence
  Description of Artificial Sequence: Synthetic peptide
  XENP019416 vlCDR2
GAFSRAT

SEQ ID NO: 8974 - protein, 9 aa, Artificial Sequence
  Description of Artificial Sequence: Synthetic peptide
  XENP019416 vlCDR3
QQYGSSPWT

SEQ ID NO: 8975 - protein, 221 aa, Artificial Sequence; identical to SEQ ID NO: 7595
  Description of Artificial Sequence: Synthetic polypeptide
  XENP019417 [CTLA-4]_H0_L0.2_Fab Heavy Chain

SEQ ID NO: 8976 - protein, 118 aa, Artificial Sequence; identical to SEQ ID NO: 3737
  Description of Artificial Sequence: Synthetic polypeptide
  VH of XENP019417

SEQ ID NO: 8977 - protein, 5 aa, Artificial Sequence
  Description of Artificial Sequence: Synthetic peptide
  XENP019417 vhCDR1
SYTMH

SEQ ID NO: 8978 - protein, 17 aa, Artificial Sequence
  Description of Artificial Sequence: Synthetic peptide
  XENP019417 vhCDR2
FISYDGNNKYYADSVKG

SEQ ID NO: 8979 - protein, 9 aa, Artificial Sequence
  Description of Artificial Sequence: Synthetic peptide
  XENP019417 vhCDR3
TGWLGPFDY

SEQ ID NO: 8980 - protein, 215 aa, Artificial Sequence
  Description of Artificial Sequence: Synthetic polypeptide
  XENP019417 [CTLA-4]_H0_L0.2_Fab Light Chain
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8981 - protein, 108 aa, Artificial Sequence; identical to SEQ ID NO: 6103
  Description of Artificial Sequence: Synthetic polypeptide
  VL of XENP019417

SEQ ID NO: 8982 - protein, 12 aa, Artificial Sequence
  Description of Artificial Sequence: Synthetic peptide
  XENP019417 vlCDR1
RASQSVGSSYLA

SEQ ID NO: 8983 - protein, 7 aa, Artificial Sequence
  Description of Artificial Sequence: Synthetic peptide
  XENP019417 vlCDR2
GAFSRAT

SEQ ID NO: 8984 - protein, 9 aa, Artificial Sequence
  Description of Artificial Sequence: Synthetic peptide
  XENP019417 vlCDR3
QQYGSSPWT

SEQ ID NO: 8985 - protein, 221 aa, Artificial Sequence; identical to SEQ ID NO: 7595
  Description of Artificial Sequence: Synthetic polypeptide
  XENP019418 [CTLA-4]_H0_L0.3_Fab Heavy Chain

SEQ ID NO: 8986 - protein, 118 aa, Artificial Sequence; identical to SEQ ID NO: 3737
  Description of Artificial Sequence: Synthetic polypeptide
  VH of XENP019418

SEQ ID NO: 8987 - protein, 5 aa, Artificial Sequence
  Description of Artificial Sequence: Synthetic peptide
  XENP019418 vhCDR1
SYTMH

SEQ ID NO: 8988 - protein, 17 aa, Artificial Sequence
  Description of Artificial Sequence: Synthetic peptide
  XENP019418 vhCDR2
FISYDGNNKYYADSVKG

SEQ ID NO: 8989 - protein, 9 aa, Artificial Sequence
  Description of Artificial Sequence: Synthetic peptide
  XENP019418 vhCDR3
TGWLGPFDY

SEQ ID NO: 8990 - protein, 215 aa, Artificial Sequence
  Description of Artificial Sequence: Synthetic polypeptide
  XENP019418 [CTLA-4]_H0_L0.3_Fab Light Chain
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8991 - protein, 108 aa, Artificial Sequence; identical to SEQ ID NO: 6112
  Description of Artificial Sequence: Synthetic polypeptide
  VL of XENP019418

SEQ ID NO: 8992 - protein, 12 aa, Artificial Sequence
  Description of Artificial Sequence: Synthetic peptide
  XENP019418 vlCDR1
RASQSVGSSYLA

SEQ ID NO: 8993 - protein, 7 aa, Artificial Sequence
  Description of Artificial Sequence: Synthetic peptide
  XENP019418 vlCDR2
GAFSRAT

SEQ ID NO: 8994 - protein, 9 aa, Artificial Sequence
  Description of Artificial Sequence: Synthetic peptide
  XENP019418 vlCDR3
QQYGSSPWT

SEQ ID NO: 8995 - protein, 221 aa, Artificial Sequence; identical to SEQ ID NO: 7595
  Description of Artificial Sequence: Synthetic polypeptide
  XENP019419 [CTLA-4]_H0_L0.4_Fab Heavy Chain

SEQ ID NO: 8996 - protein, 118 aa, Artificial Sequence; identical to SEQ ID NO: 3737
  Description of Artificial Sequence: Synthetic polypeptide
  VH of XENP019419

SEQ ID NO: 8997 - protein, 5 aa, Artificial Sequence
  Description of Artificial Sequence: Synthetic peptide
  XENP019419 vhCDR1
SYTMH

SEQ ID NO: 8998 - protein, 17 aa, Artificial Sequence
  Description of Artificial Sequence: Synthetic peptide
  XENP019419 vhCDR2
FISYDGNNKYYADSVKG

SEQ ID NO: 8999 - protein, 9 aa, Artificial Sequence
  Description of Artificial Sequence: Synthetic peptide
  XENP019419 vhCDR3
TGWLGPFDY

SEQ ID NO: 9000 - protein, 215 aa, Artificial Sequence
  Description of Artificial Sequence: Synthetic polypeptide
  XENP019419 [CTLA-4]_H0_L0.4_Fab Light Chain
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9001 - protein, 108 aa, Artificial Sequence; identical to SEQ ID NO: 6121
  Description of Artificial Sequence: Synthetic polypeptide
  VL of XENP019419

SEQ ID NO: 9002 - protein, 12 aa, Artificial Sequence
  Description of Artificial Sequence: Synthetic peptide
  XENP019419 vlCDR1
RASQSVGSSYLA

SEQ ID NO: 9003 - protein, 7 aa, Artificial Sequence
  Description of Artificial Sequence: Synthetic peptide
  XENP019419 vlCDR2
GAFSRAT

SEQ ID NO: 9004 - protein, 9 aa, Artificial Sequence
  Description of Artificial Sequence: Synthetic peptide
  XENP019419 vlCDR3
QQYGSSPWT

SEQ ID NO: 9005 - protein, 221 aa, Artificial Sequence; identical to SEQ ID NO: 7595
  Description of Artificial Sequence: Synthetic polypeptide
  XENP019420 [CTLA-4]_H0_L0.5_Fab Heavy Chain

SEQ ID NO: 9006 - protein, 118 aa, Artificial Sequence; identical to SEQ ID NO: 3737
  Description of Artificial Sequence: Synthetic polypeptide
  VH of XENP019420

SEQ ID NO: 9007 - protein, 5 aa, Artificial Sequence
  Description of Artificial Sequence: Synthetic peptide
  XENP019420 vhCDR1
SYTMH

SEQ ID NO: 9008 - protein, 17 aa, Artificial Sequence
  Description of Artificial Sequence: Synthetic peptide
  XENP019420 vhCDR2
FISYDGNNKYYADSVKG

SEQ ID NO: 9009 - protein, 9 aa, Artificial Sequence
  Description of Artificial Sequence: Synthetic peptide
  XENP019420 vhCDR3
TGWLGPFDY

SEQ ID NO: 9010 - protein, 215 aa, Artificial Sequence
  Description of Artificial Sequence: Synthetic polypeptide
  XENP019420 [CTLA-4]_H0_L0.5_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9011 - protein, 108 aa, Artificial Sequence; identical to SEQ ID NO: 6130
  Description of Artificial Sequence: Synthetic polypeptide
  VL of XENP019420

SEQ ID NO: 9012 - protein, 12 aa, Artificial Sequence
  Description of Artificial Sequence: Synthetic peptide
  XENP019420 vlCDR1
RASQSVGSSYLA

SEQ ID NO: 9013 - protein, 7 aa, Artificial Sequence
  Description of Artificial Sequence: Synthetic peptide
  XENP019420 vlCDR2
GAFSRAT

SEQ ID NO: 9014 - protein, 9 aa, Artificial Sequence
  Description of Artificial Sequence: Synthetic peptide
  XENP019420 vlCDR3
QQYGSSPWT

SEQ ID NO: 9015 - protein, 221 aa, Artificial Sequence; identical to SEQ ID NO: 7595
  Description of Artificial Sequence: Synthetic polypeptide
  XENP019421 [CTLA-4]_H0_L0.6_Fab Heavy Chain

SEQ ID NO: 9016 - protein, 118 aa, Artificial Sequence; identical to SEQ ID NO: 3737
  Description of Artificial Sequence: Synthetic polypeptide
  VH of XENP019421

SEQ ID NO: 9017 - protein, 5 aa, Artificial Sequence
  Description of Artificial Sequence: Synthetic peptide
  XENP019421 vhCDR1
SYTMH

SEQ ID NO: 9018 - protein, 17 aa, Artificial Sequence
  Description of Artificial Sequence: Synthetic peptide
  XENP019421 vhCDR2
FISYDGNNKYYADSVKG

SEQ ID NO: 9019 - protein, 9 aa, Artificial Sequence
  Description of Artificial Sequence: Synthetic peptide
  XENP019421 vhCDR3
TGWLGPFDY

SEQ ID NO: 9020 - protein, 215 aa, Artificial Sequence
  Description of Artificial Sequence: Synthetic polypeptide
  XENP019421 [CTLA-4]_H0_L0.6_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9021 - protein, 108 aa, Artificial Sequence; identical to SEQ ID NO: 6139
  Description of Artificial Sequence: Synthetic polypeptide
  VL of XENP019421

SEQ ID NO: 9022 - protein, 12 aa, Artificial Sequence
  Description of Artificial Sequence: Synthetic peptide
  XENP019421 vlCDR1
RASQSVGSSYLA

SEQ ID NO: 9023 - protein, 7 aa, Artificial Sequence
  Description of Artificial Sequence: Synthetic peptide
  XENP019421 vlCDR2
GAFSRAT

SEQ ID NO: 9024 - protein, 9 aa, Artificial Sequence
  Description of Artificial Sequence: Synthetic peptide
  XENP019421 vlCDR3
QQYGSSPWT

SEQ ID NO: 9025 - protein, 221 aa, Artificial Sequence; identical to SEQ ID NO: 7595
  Description of Artificial Sequence: Synthetic polypeptide
  XENP019422 [CTLA-4]_H0_L0.7_Fab Heavy Chain

SEQ ID NO: 9026 - protein, 118 aa, Artificial Sequence; identical to SEQ ID NO: 3737
  Description of Artificial Sequence: Synthetic polypeptide
  VH of XENP019422

SEQ ID NO: 9027 - protein, 5 aa, Artificial Sequence
  Description of Artificial Sequence: Synthetic peptide
  XENP019422 vhCDR1
SYTMH

SEQ ID NO: 9028 - protein, 17 aa, Artificial Sequence
  Description of Artificial Sequence: Synthetic peptide
  XENP019422 vhCDR2
FISYDGNNKYYADSVKG

SEQ ID NO: 9029 - protein, 9 aa, Artificial Sequence
  Description of Artificial Sequence: Synthetic peptide
  XENP019422 vhCDR3
TGWLGPFDY

SEQ ID NO: 9030 - protein, 215 aa, Artificial Sequence
  Description of Artificial Sequence: Synthetic polypeptide
  XENP019422 [CTLA-4]_H0_L0.7_Fab Light Chain
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9031 - protein, 108 aa, Artificial Sequence; identical to SEQ ID NO: 6148
  Description of Artificial Sequence: Synthetic polypeptide
  VL of XENP019422

SEQ ID NO: 9032 - protein, 12 aa, Artificial Sequence
  Description of Artificial Sequence: Synthetic peptide
  XENP019422 vlCDR1
RASQSVGSSYLA

SEQ ID NO: 9033 - protein, 7 aa, Artificial Sequence
  Description of Artificial Sequence: Synthetic peptide
  XENP019422 vlCDR2
GAFSRAT

SEQ ID NO: 9034 - protein, 9 aa, Artificial Sequence
  Description of Artificial Sequence: Synthetic peptide
  XENP019422 vlCDR3
QQYGSSPWT

SEQ ID NO: 9035 - protein, 221 aa, Artificial Sequence; identical to SEQ ID NO: 7595
  Description of Artificial Sequence: Synthetic polypeptide
  XENP019423 [CTLA-4]_H0_L0.8_Fab Heavy Chain

SEQ ID NO: 9036 - protein, 118 aa, Artificial Sequence; identical to SEQ ID NO: 3737
  Description of Artificial Sequence: Synthetic polypeptide
  VH of XENP019423

SEQ ID NO: 9037 - protein, 5 aa, Artificial Sequence
  Description of Artificial Sequence: Synthetic peptide
  XENP019423 vhCDR1
SYTMH

SEQ ID NO: 9038 - protein, 17 aa, Artificial Sequence
  Description of Artificial Sequence: Synthetic peptide
  XENP019423 vhCDR2
FISYDGNNKYYADSVKG

SEQ ID NO: 9039 - protein, 9 aa, Artificial Sequence
  Description of Artificial Sequence: Synthetic peptide
  XENP019423 vhCDR3
TGWLGPFDY

SEQ ID NO: 9040 - protein, 215 aa, Artificial Sequence
  Description of Artificial Sequence: Synthetic polypeptide
  XENP019423 [CTLA-4]_H0_L0.8_Fab Light Chain
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9041 - protein, 108 aa, Artificial Sequence; identical to SEQ ID NO: 6157
  Description of Artificial Sequence: Synthetic polypeptide
  VL of XENP019423

SEQ ID NO: 9042 - protein, 12 aa, Artificial Sequence
  Description of Artificial Sequence: Synthetic peptide
  XENP019423 vlCDR1
RASQSVGSSYLA

SEQ ID NO: 9043 - protein, 7 aa, Artificial Sequence
  Description of Artificial Sequence: Synthetic peptide
  XENP019423 vlCDR2
GAFSRAT

SEQ ID NO: 9044 - protein, 9 aa, Artificial Sequence
  Description of Artificial Sequence: Synthetic peptide
  XENP019423 vlCDR3
QQYGSSPWT

SEQ ID NO: 9045 - protein, 221 aa, Artificial Sequence; identical to SEQ ID NO: 7595
  Description of Artificial Sequence: Synthetic polypeptide
  XENP019424 [CTLA-4]_H0_L0.9_Fab Heavy Chain

SEQ ID NO: 9046 - protein, 118 aa, Artificial Sequence; identical to SEQ ID NO: 3737
  Description of Artificial Sequence: Synthetic polypeptide
  VH of XENP019424

SEQ ID NO: 9047 - protein, 5 aa, Artificial Sequence
  Description of Artificial Sequence: Synthetic peptide
  XENP019424 vhCDR1
SYTMH

SEQ ID NO: 9048 - protein, 17 aa, Artificial Sequence
  Description of Artificial Sequence: Synthetic peptide
  XENP019424 vhCDR2
FISYDGNNKYYADSVKG

SEQ ID NO: 9049 - protein, 9 aa, Artificial Sequence
  Description of Artificial Sequence: Synthetic peptide
  XENP019424 vhCDR3
TGWLGPFDY

SEQ ID NO: 9050 - protein, 215 aa, Artificial Sequence
  Description of Artificial Sequence: Synthetic polypeptide
  XENP019424 [CTLA-4]_H0_L0.9_Fab Light Chain
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9051 - protein, 108 aa, Artificial Sequence; identical to SEQ ID NO: 6166
  Description of Artificial Sequence: Synthetic polypeptide
  VL of XENP019424

SEQ ID NO: 9052 - protein, 12 aa, Artificial Sequence
  Description of Artificial Sequence: Synthetic peptide
  XENP019424 vlCDR1
RASQSVGSSYLA

SEQ ID NO: 9053 - protein, 7 aa, Artificial Sequence
  Description of Artificial Sequence: Synthetic peptide
  XENP019424 vlCDR2
GAFSRAT

SEQ ID NO: 9054 - protein, 9 aa, Artificial Sequence
  Description of Artificial Sequence: Synthetic peptide
  XENP019424 vlCDR3
QQYGSSPWT

SEQ ID NO: 9055 - protein, 221 aa, Artificial Sequence; identical to SEQ ID NO: 7595
  Description of Artificial Sequence: Synthetic polypeptide
  XENP019425 [CTLA-4]_H0_L0.10_Fab Heavy Chain

SEQ ID NO: 9056 - protein, 118 aa, Artificial Sequence; identical to SEQ ID NO: 3737
  Description of Artificial Sequence: Synthetic polypeptide
  VH of XENP019425

SEQ ID NO: 9057 - protein, 5 aa, Artificial Sequence
  Description of Artificial Sequence: Synthetic peptide
  XENP019425 vhCDR1
SYTMH

SEQ ID NO: 9058 - protein, 17 aa, Artificial Sequence
  Description of Artificial Sequence: Synthetic peptide
  XENP019425 vhCDR2
FISYDGNNKYYADSVKG

SEQ ID NO: 9059 - protein, 9 aa, Artificial Sequence
  Description of Artificial Sequence: Synthetic peptide
  XENP019425 vhCDR3
TGWLGPFDY

SEQ ID NO: 9060 - protein, 215 aa, Artificial Sequence
  Description of Artificial Sequence: Synthetic polypeptide
  XENP019425 [CTLA-4]_H0_L0.10_Fab Light Chain
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9061 - protein, 108 aa, Artificial Sequence; identical to SEQ ID NO: 6175
  Description of Artificial Sequence: Synthetic polypeptide
  VL of XENP019425

SEQ ID NO: 9062 - protein, 12 aa, Artificial Sequence
  Description of Artificial Sequence: Synthetic peptide
  XENP019425 vlCDR1
RASQSVGSSYLA

SEQ ID NO: 9063 - protein, 7 aa, Artificial Sequence
  Description of Artificial Sequence: Synthetic peptide
  XENP019425 vlCDR2
GAFSRAT

SEQ ID NO: 9064 - protein, 9 aa, Artificial Sequence
  Description of Artificial Sequence: Synthetic peptide
  XENP019425 vlCDR3
QQYGSSPWT

SEQ ID NO: 9065 - protein, 221 aa, Artificial Sequence; identical to SEQ ID NO: 7595
  Description of Artificial Sequence: Synthetic polypeptide
  XENP019426 [CTLA-4]_H0_L0.11_Fab Heavy Chain

SEQ ID NO: 9066 - protein, 118 aa, Artificial Sequence; identical to SEQ ID NO: 3737
  Description of Artificial Sequence: Synthetic polypeptide
  VH of XENP019426

SEQ ID NO: 9067 - protein, 5 aa, Artificial Sequence
  Description of Artificial Sequence: Synthetic peptide
  XENP019426 vhCDR1
SYTMH

SEQ ID NO: 9068 - protein, 17 aa, Artificial Sequence
  Description of Artificial Sequence: Synthetic peptide
  XENP019426 vhCDR2
FISYDGNNKYYADSVKG

SEQ ID NO: 9069 - protein, 9 aa, Artificial Sequence
  Description of Artificial Sequence: Synthetic peptide
  XENP019426 vhCDR3
TGWLGPFDY

SEQ ID NO: 9070 - protein, 215 aa, Artificial Sequence
  Description of Artificial Sequence: Synthetic polypeptide
  XENP019426 [CTLA-4]_H0_L0.11_Fab Light Chain
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9071 - protein, 108 aa, Artificial Sequence; identical to SEQ ID NO: 6184
  Description of Artificial Sequence: Synthetic polypeptide
  VL of XENP019426

SEQ ID NO: 9072 - protein, 12 aa, Artificial Sequence
  Description of Artificial Sequence: Synthetic peptide
  XENP019426 vlCDR1
RASQSVGSSYLA

SEQ ID NO: 9073 - protein, 7 aa, Artificial Sequence
  Description of Artificial Sequence: Synthetic peptide
  XENP019426 vlCDR2
GAFSRAT

SEQ ID NO: 9074 - protein, 9 aa, Artificial Sequence
  Description of Artificial Sequence: Synthetic peptide
  XENP019426 vlCDR3
QQYGSSPWT

SEQ ID NO: 9075 - protein, 221 aa, Artificial Sequence; identical to SEQ ID NO: 7595
  Description of Artificial Sequence: Synthetic polypeptide
  XENP019427 [CTLA-4]_H0_L0.12_Fab Heavy Chain

SEQ ID NO: 9076 - protein, 118 aa, Artificial Sequence; identical to SEQ ID NO: 3737
  Description of Artificial Sequence: Synthetic polypeptide
  VH of XENP019427

SEQ ID NO: 9077 - protein, 5 aa, Artificial Sequence
  Description of Artificial Sequence: Synthetic peptide
  XENP019427 vhCDR1
SYTMH

SEQ ID NO: 9078 - protein, 17 aa, Artificial Sequence
  Description of Artificial Sequence: Synthetic peptide
  XENP019427 vhCDR2
FISYDGNNKYYADSVKG

SEQ ID NO: 9079 - protein, 9 aa, Artificial Sequence
  Description of Artificial Sequence: Synthetic peptide
  XENP019427 vhCDR3
TGWLGPFDY

SEQ ID NO: 9080 - protein, 215 aa, Artificial Sequence
  Description of Artificial Sequence: Synthetic polypeptide
  XENP019427 [CTLA-4]_H0_L0.12_Fab Light Chain
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9081 - protein, 108 aa, Artificial Sequence; identical to SEQ ID NO: 6193
  Description of Artificial Sequence: Synthetic polypeptide
  VL of XENP019427

SEQ ID NO: 9082 - protein, 12 aa, Artificial Sequence
  Description of Artificial Sequence: Synthetic peptide
  XENP019427 vlCDR1
RASQSVGSSYLA

SEQ ID NO: 9083 - protein, 7 aa, Artificial Sequence
  Description of Artificial Sequence: Synthetic peptide
  XENP019427 vlCDR2
GAFSRAT

SEQ ID NO: 9084 - protein, 9 aa, Artificial Sequence
  Description of Artificial Sequence: Synthetic peptide
  XENP019427 vlCDR3
QQYGSSPWT

SEQ ID NO: 9085 - protein, 221 aa, Artificial Sequence; identical to SEQ ID NO: 7595
  Description of Artificial Sequence: Synthetic polypeptide
  XENP019428 [CTLA-4]_H0_L0.13_Fab Heavy Chain

SEQ ID NO: 9086 - protein, 118 aa, Artificial Sequence; identical to SEQ ID NO: 3737
  Description of Artificial Sequence: Synthetic polypeptide
  VH of XENP019428

SEQ ID NO: 9087 - protein, 5 aa, Artificial Sequence
  Description of Artificial Sequence: Synthetic peptide
  XENP019428 vhCDR1
SYTMH

SEQ ID NO: 9088 - protein, 17 aa, Artificial Sequence
  Description of Artificial Sequence: Synthetic peptide
  XENP019428 vhCDR2
FISYDGNNKYYADSVKG

SEQ ID NO: 9089 - protein, 9 aa, Artificial Sequence
  Description of Artificial Sequence: Synthetic peptide
  XENP019428 vhCDR3
TGWLGPFDY

SEQ ID NO: 9090 - protein, 215 aa, Artificial Sequence
  Description of Artificial Sequence: Synthetic polypeptide
  XENP019428 [CTLA-4]_H0_L0.13_Fab Light Chain
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9091 - protein, 108 aa, Artificial Sequence; identical to SEQ ID NO: 6202
  Description of Artificial Sequence: Synthetic polypeptide
  VL of XENP019428

SEQ ID NO: 9092 - protein, 12 aa, Artificial Sequence
  Description of Artificial Sequence: Synthetic peptide
  XENP019428 vlCDR1
RASQSVGSSYLA

SEQ ID NO: 9093 - protein, 7 aa, Artificial Sequence
  Description of Artificial Sequence: Synthetic peptide
  XENP019428 vlCDR2
GAFSRAT

SEQ ID NO: 9094 - protein, 9 aa, Artificial Sequence
  Description of Artificial Sequence: Synthetic peptide
  XENP019428 vlCDR3
QQYGSSPWT

SEQ ID NO: 9095 - protein, 221 aa, Artificial Sequence; identical to SEQ ID NO: 7595
  Description of Artificial Sequence: Synthetic polypeptide
  XENP019429 [CTLA-4]_H0_L0.14_Fab Heavy Chain

SEQ ID NO: 9096 - protein, 118 aa, Artificial Sequence; identical to SEQ ID NO: 3737
  Description of Artificial Sequence: Synthetic polypeptide
  VH of XENP019429

SEQ ID NO: 9097 - protein, 5 aa, Artificial Sequence
  Description of Artificial Sequence: Synthetic peptide
  XENP019429 vhCDR1
SYTMH

SEQ ID NO: 9098 - protein, 17 aa, Artificial Sequence
  Description of Artificial Sequence: Synthetic peptide
  XENP019429 vhCDR2
FISYDGNNKYYADSVKG

SEQ ID NO: 9099 - protein, 9 aa, Artificial Sequence
  Description of Artificial Sequence: Synthetic peptide
  XENP019429 vhCDR3
TGWLGPFDY

SEQ ID NO: 9100 - protein, 215 aa, Artificial Sequence
  Description of Artificial Sequence: Synthetic polypeptide
  XENP019429 [CTLA-4]_H0_L0.14_Fab Light Chain
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9101 - protein, 108 aa, Artificial Sequence; identical to SEQ ID NO: 6211
  Description of Artificial Sequence: Synthetic polypeptide
  VL of XENP019429

SEQ ID NO: 9102 - protein, 12 aa, Artificial Sequence
  Description of Artificial Sequence: Synthetic peptide
  XENP019429 vlCDR1
RASQSVGSSYLA

SEQ ID NO: 9103 - protein, 7 aa, Artificial Sequence
  Description of Artificial Sequence: Synthetic peptide
  XENP019429 vlCDR2
GAFSRAT

SEQ ID NO: 9104 - protein, 9 aa, Artificial Sequence
  Description of Artificial Sequence: Synthetic peptide
  XENP019429 vlCDR3
QQYGSSPWT

SEQ ID NO: 9105 - protein, 221 aa, Artificial Sequence; identical to SEQ ID NO: 7595
  Description of Artificial Sequence: Synthetic polypeptide
  XENP019430 [CTLA-4]_H0_L0.15_Fab Heavy Chain

SEQ ID NO: 9106 - protein, 118 aa, Artificial Sequence; identical to SEQ ID NO: 3737
  Description of Artificial Sequence: Synthetic polypeptide
  VH of XENP019430

SEQ ID NO: 9107 - protein, 5 aa, Artificial Sequence
  Description of Artificial Sequence: Synthetic peptide
  XENP019430 vhCDR1
SYTMH

SEQ ID NO: 9108 - protein, 17 aa, Artificial Sequence
  Description of Artificial Sequence: Synthetic peptide
  XENP019430 vhCDR2
FISYDGNNKYYADSVKG

SEQ ID NO: 9109 - protein, 9 aa, Artificial Sequence
  Description of Artificial Sequence: Synthetic peptide
  XENP019430 vhCDR3
TGWLGPFDY

SEQ ID NO: 9110 - protein, 215 aa, Artificial Sequence
  Description of Artificial Sequence: Synthetic polypeptide
  XENP019430 [CTLA-4]_H0_L0.15_Fab Light Chain
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9111 - protein, 108 aa, Artificial Sequence; identical to SEQ ID NO: 6220
  Description of Artificial Sequence: Synthetic polypeptide
  VL of XENP019430

SEQ ID NO: 9112 - protein, 12 aa, Artificial Sequence
  Description of Artificial Sequence: Synthetic peptide
  XENP019430 vlCDR1
RASQSVGSSYLA

SEQ ID NO: 9113 - protein, 7 aa, Artificial Sequence
  Description of Artificial Sequence: Synthetic peptide
  XENP019430 vlCDR2
GAFSRAT

SEQ ID NO: 9114 - protein, 9 aa, Artificial Sequence
  Description of Artificial Sequence: Synthetic peptide
  XENP019430 vlCDR3
QQYGSSPWT

SEQ ID NO: 9115 - protein, 221 aa, Artificial Sequence; identical to SEQ ID NO: 7595
  Description of Artificial Sequence: Synthetic polypeptide
  XENP019431 [CTLA-4]_H0_L0.16_Fab Heavy Chain

SEQ ID NO: 9116 - protein, 118 aa, Artificial Sequence; identical to SEQ ID NO: 3737
  Description of Artificial Sequence: Synthetic polypeptide
  VH of XENP019431

SEQ ID NO: 9117 - protein, 5 aa, Artificial Sequence
  Description of Artificial Sequence: Synthetic peptide
  XENP019431 vhCDR1
SYTMH

SEQ ID NO: 9118 - protein, 17 aa, Artificial Sequence
  Description of Artificial Sequence: Synthetic peptide
  XENP019431 vhCDR2
FISYDGNNKYYADSVKG

SEQ ID NO: 9119 - protein, 9 aa, Artificial Sequence
  Description of Artificial Sequence: Synthetic peptide
  XENP019431 vhCDR3
TGWLGPFDY

SEQ ID NO: 9120 - protein, 215 aa, Artificial Sequence
  Description of Artificial Sequence: Synthetic polypeptide
  XENP019431 [CTLA-4]_H0_L0.16_Fab Light Chain
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9121 - protein, 108 aa, Artificial Sequence; identical to SEQ ID NO: 6229
  Description of Artificial Sequence: Synthetic polypeptide
  VL of XENP019431

SEQ ID NO: 9122 - protein, 12 aa, Artificial Sequence
  Description of Artificial Sequence: Synthetic peptide
  XENP019431 vlCDR1
RASQSVGSSYLA

SEQ ID NO: 9123 - protein, 7 aa, Artificial Sequence
  Description of Artificial Sequence: Synthetic peptide
  XENP019431 vlCDR2
GAFSRAT

SEQ ID NO: 9124 - protein, 9 aa, Artificial Sequence
  Description of Artificial Sequence: Synthetic peptide
  XENP019431 vlCDR3
QQYGSSPWT

SEQ ID NO: 9125 - protein, 221 aa, Artificial Sequence; identical to SEQ ID NO: 7595
  Description of Artificial Sequence: Synthetic polypeptide
  XENP019432 [CTLA-4]_H0_L0.17_Fab Heavy Chain

SEQ ID NO: 9126 - protein, 118 aa, Artificial Sequence; identical to SEQ ID NO: 3737
  Description of Artificial Sequence: Synthetic polypeptide
  VH of XENP019432

SEQ ID NO: 9127 - protein, 5 aa, Artificial Sequence
  Description of Artificial Sequence: Synthetic peptide
  XENP019432 vhCDR1
SYTMH

SEQ ID NO: 9128 - protein, 17 aa, Artificial Sequence
  Description of Artificial Sequence: Synthetic peptide
  XENP019432 vhCDR2
FISYDGNNKYYADSVKG

SEQ ID NO: 9129 - protein, 9 aa, Artificial Sequence
  Description of Artificial Sequence: Synthetic peptide
  XENP019432 vhCDR3
TGWLGPFDY

SEQ ID NO: 9130 - protein, 215 aa, Artificial Sequence
  Description of Artificial Sequence: Synthetic polypeptide
  XENP019432 [CTLA-4]_H0_L0.17_Fab Light Chain
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9131 - protein, 108 aa, Artificial Sequence; identical to SEQ ID NO: 6238
  Description of Artificial Sequence: Synthetic polypeptide
  VL of XENP019432

SEQ ID NO: 9132 - protein, 12 aa, Artificial Sequence
  Description of Artificial Sequence: Synthetic peptide
  XENP019432 vlCDR1
RASQSVGSSYLA

SEQ ID NO: 9133 - protein, 7 aa, Artificial Sequence
  Description of Artificial Sequence: Synthetic peptide
  XENP019432 vlCDR2
GAFSRAT

SEQ ID NO: 9134 - protein, 9 aa, Artificial Sequence
  Description of Artificial Sequence: Synthetic peptide
  XENP019432 vlCDR3
QQYGSSPWT

SEQ ID NO: 9135 - protein, 221 aa, Artificial Sequence; identical to SEQ ID NO: 7595
  Description of Artificial Sequence: Synthetic polypeptide
  XENP019433 [CTLA-4]_H0_L0.18_Fab Heavy Chain

SEQ ID NO: 9136 - protein, 118 aa, Artificial Sequence; identical to SEQ ID NO: 3737
  Description of Artificial Sequence: Synthetic polypeptide
  VH of XENP019433

SEQ ID NO: 9137 - protein, 5 aa, Artificial Sequence
  Description of Artificial Sequence: Synthetic peptide
  XENP019433 vhCDR1
SYTMH

SEQ ID NO: 9138 - protein, 17 aa, Artificial Sequence
  Description of Artificial Sequence: Synthetic peptide
  XENP019433 vhCDR2
FISYDGNNKYYADSVKG

SEQ ID NO: 9139 - protein, 9 aa, Artificial Sequence
  Description of Artificial Sequence: Synthetic peptide
  XENP019433 vhCDR3
TGWLGPFDY

SEQ ID NO: 9140 - protein, 215 aa, Artificial Sequence
  Description of Artificial Sequence: Synthetic polypeptide
  XENP019433 [CTLA-4]_H0_L0.18_Fab Light Chain
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9141 - protein, 108 aa, Artificial Sequence; identical to SEQ ID NO: 6247
  Description of Artificial Sequence: Synthetic polypeptide
  VL of XENP019433

SEQ ID NO: 9142 - protein, 12 aa, Artificial Sequence
  Description of Artificial Sequence: Synthetic peptide
  XENP019433 vlCDR1
RSSQSVGSSYLA

SEQ ID NO: 9143 - protein, 7 aa, Artificial Sequence
  Description of Artificial Sequence: Synthetic peptide
  XENP019433 vlCDR2
GAFSRAT

SEQ ID NO: 9144 - protein, 9 aa, Artificial Sequence
  Description of Artificial Sequence: Synthetic peptide
  XENP019433 vlCDR3
QQYGSSPWT

SEQ ID NO: 9145 - protein, 221 aa, Artificial Sequence; identical to SEQ ID NO: 7595
  Description of Artificial Sequence: Synthetic polypeptide
  XENP019434 [CTLA-4]_H0_L0.19_Fab Heavy Chain

SEQ ID NO: 9146 - protein, 118 aa, Artificial Sequence; identical to SEQ ID NO: 3737
  Description of Artificial Sequence: Synthetic polypeptide
  VH of XENP019434

SEQ ID NO: 9147 - protein, 5 aa, Artificial Sequence
  Description of Artificial Sequence: Synthetic peptide
  XENP019434 vhCDR1
SYTMH

SEQ ID NO: 9148 - protein, 17 aa, Artificial Sequence
  Description of Artificial Sequence: Synthetic peptide
  XENP019434 vhCDR2
FISYDGNNKYYADSVKG

SEQ ID NO: 9149 - protein, 9 aa, Artificial Sequence
  Description of Artificial Sequence: Synthetic peptide
  XENP019434 vhCDR3
TGWLGPFDY

SEQ ID NO: 9150 - protein, 215 aa, Artificial Sequence
  Description of Artificial Sequence: Synthetic polypeptide
  XENP019434 [CTLA-4]_H0_L0.19_Fab Light Chain
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9151 - protein, 108 aa, Artificial Sequence; identical to SEQ ID NO: 6256
  Description of Artificial Sequence: Synthetic polypeptide
  VL of XENP019434

SEQ ID NO: 9152 - protein, 12 aa, Artificial Sequence
  Description of Artificial Sequence: Synthetic peptide
  XENP019434 vlCDR1
RASQSDGSSYLA

SEQ ID NO: 9153 - protein, 7 aa, Artificial Sequence
  Description of Artificial Sequence: Synthetic peptide
  XENP019434 vlCDR2
GAFSRAT

SEQ ID NO: 9154 - protein, 9 aa, Artificial Sequence
  Description of Artificial Sequence: Synthetic peptide
  XENP019434 vlCDR3
QQYGSSPWT

SEQ ID NO: 9155 - protein, 221 aa, Artificial Sequence; identical to SEQ ID NO: 7595
  Description of Artificial Sequence: Synthetic polypeptide
  XENP019435 [CTLA-4]_H0_L0.20_Fab Heavy Chain

SEQ ID NO: 9156 - protein, 118 aa, Artificial Sequence; identical to SEQ ID NO: 3737
  Description of Artificial Sequence: Synthetic polypeptide
  VH of XENP019435

SEQ ID NO: 9157 - protein, 5 aa, Artificial Sequence
  Description of Artificial Sequence: Synthetic peptide
  XENP019435 vhCDR1
SYTMH

SEQ ID NO: 9158 - protein, 17 aa, Artificial Sequence
  Description of Artificial Sequence: Synthetic peptide
  XENP019435 vhCDR2
FISYDGNNKYYADSVKG

SEQ ID NO: 9159 - protein, 9 aa, Artificial Sequence
  Description of Artificial Sequence: Synthetic peptide
  XENP019435 vhCDR3
TGWLGPFDY

SEQ ID NO: 9160 - protein, 215 aa, Artificial Sequence
  Description of Artificial Sequence: Synthetic polypeptide
  XENP019435 [CTLA-4]_H0_L0.20_Fab Light Chain
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9161 - protein, 108 aa, Artificial Sequence; identical to SEQ ID NO: 6265
  Description of Artificial Sequence: Synthetic polypeptide
  VL of XENP019435

SEQ ID NO: 9162 - protein, 12 aa, Artificial Sequence
  Description of Artificial Sequence: Synthetic peptide
  XENP019435 vlCDR1
RASQSSGSSYLA

SEQ ID NO: 9163 - protein, 7 aa, Artificial Sequence
  Description of Artificial Sequence: Synthetic peptide
  XENP019435 vlCDR2
GAFSRAT

SEQ ID NO: 9164 - protein, 9 aa, Artificial Sequence
  Description of Artificial Sequence: Synthetic peptide
  XENP019435 vlCDR3
QQYGSSPWT

SEQ ID NO: 9165 - protein, 221 aa, Artificial Sequence; identical to SEQ ID NO: 7595
  Description of Artificial Sequence: Synthetic polypeptide
  XENP019436 [CTLA-4]_H0_L0.21_Fab Heavy Chain

SEQ ID NO: 9166 - protein, 118 aa, Artificial Sequence; identical to SEQ ID NO: 3737
  Description of Artificial Sequence: Synthetic polypeptide
  VH of XENP019436

SEQ ID NO: 9167 - protein, 5 aa, Artificial Sequence
  Description of Artificial Sequence: Synthetic peptide
  XENP019436 vhCDR1
SYTMH

SEQ ID NO: 9168 - protein, 17 aa, Artificial Sequence
  Description of Artificial Sequence: Synthetic peptide
  XENP019436 vhCDR2
FISYDGNNKYYADSVKG

SEQ ID NO: 9169 - protein, 9 aa, Artificial Sequence
  Description of Artificial Sequence: Synthetic peptide
  XENP019436 vhCDR3
TGWLGPFDY

SEQ ID NO: 9170 - protein, 215 aa, Artificial Sequence
  Description of Artificial Sequence: Synthetic polypeptide
  XENP019436 [CTLA-4]_H0_L0.21_Fab Light Chain
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9171 - protein, 108 aa, Artificial Sequence; identical to SEQ ID NO: 6274
  Description of Artificial Sequence: Synthetic polypeptide
  VL of XENP019436

SEQ ID NO: 9172 - protein, 12 aa, Artificial Sequence
  Description of Artificial Sequence: Synthetic peptide
  XENP019436 vlCDR1
RASQSVASSYLA

SEQ ID NO: 9173 - protein, 7 aa, Artificial Sequence
  Description of Artificial Sequence: Synthetic peptide
  XENP019436 vlCDR2
GAFSRAT

SEQ ID NO: 9174 - protein, 9 aa, Artificial Sequence
  Description of Artificial Sequence: Synthetic peptide
  XENP019436 vlCDR3
QQYGSSPWT

SEQ ID NO: 9175 - protein, 221 aa, Artificial Sequence; identical to SEQ ID NO: 7595
  Description of Artificial Sequence: Synthetic polypeptide
  XENP019437 [CTLA-4]_H0_L0.22_Fab Heavy Chain

SEQ ID NO: 9176 - protein, 118 aa, Artificial Sequence; identical to SEQ ID NO: 3737
  Description of Artificial Sequence: Synthetic polypeptide
  VH of XENP019437

SEQ ID NO: 9177 - protein, 5 aa, Artificial Sequence
  Description of Artificial Sequence: Synthetic peptide
  XENP019437 vhCDR1
SYTMH

SEQ ID NO: 9178 - protein, 17 aa, Artificial Sequence
  Description of Artificial Sequence: Synthetic peptide
  XENP019437 vhCDR2
FISYDGNNKYYADSVKG

SEQ ID NO: 9179 - protein, 9 aa, Artificial Sequence
  Description of Artificial Sequence: Synthetic peptide
  XENP019437 vhCDR3
TGWLGPFDY

SEQ ID NO: 9180 - protein, 215 aa, Artificial Sequence; identical to SEQ ID NO: 2410
  Description of Artificial Sequence: Synthetic polypeptide
  XENP019437 [CTLA-4]_H0_L0.22_Fab Light Chain

SEQ ID NO: 9181 - protein, 108 aa, Artificial Sequence; identical to SEQ ID NO: 2411
  Description of Artificial Sequence: Synthetic polypeptide
  VL of XENP019437

SEQ ID NO: 9182 - protein, 12 aa, Artificial Sequence
  Description of Artificial Sequence: Synthetic peptide
  XENP019437 vlCDR1
RASQSVSSSYLA

SEQ ID NO: 9183 - protein, 7 aa, Artificial Sequence
  Description of Artificial Sequence: Synthetic peptide
  XENP019437 vlCDR2
GAFSRAT

SEQ ID NO: 9184 - protein, 9 aa, Artificial Sequence
  Description of Artificial Sequence: Synthetic peptide
  XENP019437 vlCDR3
QQYGSSPWT

SEQ ID NO: 9185 - protein, 221 aa, Artificial Sequence; identical to SEQ ID NO: 7595
  Description of Artificial Sequence: Synthetic polypeptide
  XENP019438 [CTLA-4]_H0_L0.23_Fab Heavy Chain

SEQ ID NO: 9186 - protein, 118 aa, Artificial Sequence; identical to SEQ ID NO: 3737
  Description of Artificial Sequence: Synthetic polypeptide
  VH of XENP019438

SEQ ID NO: 9187 - protein, 5 aa, Artificial Sequence
  Description of Artificial Sequence: Synthetic peptide
  XENP019438 vhCDR1
SYTMH

SEQ ID NO: 9188 - protein, 17 aa, Artificial Sequence
  Description of Artificial Sequence: Synthetic peptide
  XENP019438 vhCDR2
FISYDGNNKYYADSVKG

SEQ ID NO: 9189 - protein, 9 aa, Artificial Sequence
  Description of Artificial Sequence: Synthetic peptide
  XENP019438 vhCDR3
TGWLGPFDY

SEQ ID NO: 9190 - protein, 215 aa, Artificial Sequence
  Description of Artificial Sequence: Synthetic polypeptide
  XENP019438 [CTLA-4]_H0_L0.23_Fab Light Chain
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9191 - protein, 108 aa, Artificial Sequence; identical to SEQ ID NO: 6292
  Description of Artificial Sequence: Synthetic polypeptide
  VL of XENP019438

SEQ ID NO: 9192 - protein, 12 aa, Artificial Sequence
  Description of Artificial Sequence: Synthetic peptide
  XENP019438 vlCDR1
RASQSVTSSYLA

SEQ ID NO: 9193 - protein, 7 aa, Artificial Sequence
  Description of Artificial Sequence: Synthetic peptide
  XENP019438 vlCDR2
GAFSRAT

SEQ ID NO: 9194 - protein, 9 aa, Artificial Sequence
  Description of Artificial Sequence: Synthetic peptide
  XENP019438 vlCDR3
QQYGSSPWT

SEQ ID NO: 9195 - protein, 221 aa, Artificial Sequence; identical to SEQ ID NO: 7595
  Description of Artificial Sequence: Synthetic polypeptide
  XENP019439 [CTLA-4]_H0_L0.24_Fab Heavy Chain

SEQ ID NO: 9196 - protein, 118 aa, Artificial Sequence; identical to SEQ ID NO: 3737
  Description of Artificial Sequence: Synthetic polypeptide
  VH of XENP019439

SEQ ID NO: 9197 - protein, 5 aa, Artificial Sequence
  Description of Artificial Sequence: Synthetic peptide
  XENP019439 vhCDR1
SYTMH

SEQ ID NO: 9198 - protein, 17 aa, Artificial Sequence
  Description of Artificial Sequence: Synthetic peptide
  XENP019439 vhCDR2
FISYDGNNKYYADSVKG

SEQ ID NO: 9199 - protein, 9 aa, Artificial Sequence
  Description of Artificial Sequence: Synthetic peptide
  XENP019439 vhCDR3
TGWLGPFDY

SEQ ID NO: 9200 - protein, 215 aa, Artificial Sequence
  Description of Artificial Sequence: Synthetic polypeptide
  XENP019439 [CTLA-4]_H0_L0.24_Fab Light Chain
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9201 - protein, 108 aa, Artificial Sequence; identical to SEQ ID NO: 6301
  Description of Artificial Sequence: Synthetic polypeptide
  VL of XENP019439

SEQ ID NO: 9202 - protein, 12 aa, Artificial Sequence
  Description of Artificial Sequence: Synthetic peptide
  XENP019439 vlCDR1
RASQSVGASYLA

SEQ ID NO: 9203 - protein, 7 aa, Artificial Sequence
  Description of Artificial Sequence: Synthetic peptide
  XENP019439 vlCDR2
GAFSRAT

SEQ ID NO: 9204 - protein, 9 aa, Artificial Sequence
  Description of Artificial Sequence: Synthetic peptide
  XENP019439 vlCDR3
QQYGSSPWT

SEQ ID NO: 9205 - protein, 221 aa, Artificial Sequence; identical to SEQ ID NO: 7595
  Description of Artificial Sequence: Synthetic polypeptide
  XENP019440 [CTLA-4]_H0_L0.25_Fab Heavy Chain

SEQ ID NO: 9206 - protein, 118 aa, Artificial Sequence; identical to SEQ ID NO: 3737
  Description of Artificial Sequence: Synthetic polypeptide
  VH of XENP019440

SEQ ID NO: 9207 - protein, 5 aa, Artificial Sequence
  Description of Artificial Sequence: Synthetic peptide
  XENP019440 vhCDR1
SYTMH

SEQ ID NO: 9208 - protein, 17 aa, Artificial Sequence
  Description of Artificial Sequence: Synthetic peptide
  XENP019440 vhCDR2
FISYDGNNKYYADSVKG

SEQ ID NO: 9209 - protein, 9 aa, Artificial Sequence
  Description of Artificial Sequence: Synthetic peptide
  XENP019440 vhCDR3
TGWLGPFDY

SEQ ID NO: 9210 - protein, 215 aa, Artificial Sequence
  Description of Artificial Sequence: Synthetic polypeptide
  XENP019440 [CTLA-4]_H0_L0.25_Fab Light Chain
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9211 - protein, 108 aa, Artificial Sequence; identical to SEQ ID NO: 6310
  Description of Artificial Sequence: Synthetic polypeptide
  VL of XENP019440

SEQ ID NO: 9212 - protein, 12 aa, Artificial Sequence
  Description of Artificial Sequence: Synthetic peptide
  XENP019440 vlCDR1
RASQSVGGSYLA

SEQ ID NO: 9213 - protein, 7 aa, Artificial Sequence
  Description of Artificial Sequence: Synthetic peptide
  XENP019440 vlCDR2
GAFSRAT

SEQ ID NO: 9214 - protein, 9 aa, Artificial Sequence
  Description of Artificial Sequence: Synthetic peptide
  XENP019440 vlCDR3
QQYGSSPWT

SEQ ID NO: 9215 - protein, 221 aa, Artificial Sequence; identical to SEQ ID NO: 7595
  Description of Artificial Sequence: Synthetic polypeptide
  XENP019441 [CTLA-4]_H0_L0.26_Fab Heavy Chain

SEQ ID NO: 9216 - protein, 118 aa, Artificial Sequence; identical to SEQ ID NO: 3737
  Description of Artificial Sequence: Synthetic polypeptide
  VH of XENP019441

SEQ ID NO: 9217 - protein, 5 aa, Artificial Sequence
  Description of Artificial Sequence: Synthetic peptide
  XENP019441 vhCDR1
SYTMH

SEQ ID NO: 9218 - protein, 17 aa, Artificial Sequence
  Description of Artificial Sequence: Synthetic peptide
  XENP019441 vhCDR2
FISYDGNNKYYADSVKG

SEQ ID NO: 9219 - protein, 9 aa, Artificial Sequence
  Description of Artificial Sequence: Synthetic peptide
  XENP019441 vhCDR3
TGWLGPFDY

SEQ ID NO: 9220 - protein, 215 aa, Artificial Sequence
  Description of Artificial Sequence: Synthetic polypeptide
  XENP019441 [CTLA-4]_H0_L0.26_Fab Light Chain
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9221 - protein, 108 aa, Artificial Sequence; identical to SEQ ID NO: 6319
  Description of Artificial Sequence: Synthetic polypeptide
  VL of XENP019441

SEQ ID NO: 9222 - protein, 12 aa, Artificial Sequence
  Description of Artificial Sequence: Synthetic peptide
  XENP019441 vlCDR1
RASQSVGNSYLA

SEQ ID NO: 9223 - protein, 7 aa, Artificial Sequence
  Description of Artificial Sequence: Synthetic peptide
  XENP019441 vlCDR2
GAFSRAT

SEQ ID NO: 9224 - protein, 9 aa, Artificial Sequence
  Description of Artificial Sequence: Synthetic peptide
  XENP019441 vlCDR3
QQYGSSPWT

SEQ ID NO: 9225 - protein, 221 aa, Artificial Sequence; identical to SEQ ID NO: 7595
  Description of Artificial Sequence: Synthetic polypeptide
  XENP019442 [CTLA-4]_H0_L0.27_Fab Heavy Chain

SEQ ID NO: 9226 - protein, 118 aa, Artificial Sequence; identical to SEQ ID NO: 3737
  Description of Artificial Sequence: Synthetic polypeptide
  VH of XENP019442

SEQ ID NO: 9227 - protein, 5 aa, Artificial Sequence
  Description of Artificial Sequence: Synthetic peptide
  XENP019442 vhCDR1
SYTMH

SEQ ID NO: 9228 - protein, 17 aa, Artificial Sequence
  Description of Artificial Sequence: Synthetic peptide
  XENP019442 vhCDR2
FISYDGNNKYYADSVKG

SEQ ID NO: 9229 - protein, 9 aa, Artificial Sequence
  Description of Artificial Sequence: Synthetic peptide
  XENP019442 vhCDR3
TGWLGPFDY

SEQ ID NO: 9230 - protein, 215 aa, Artificial Sequence
  Description of Artificial Sequence: Synthetic polypeptide
  XENP019442 [CTLA-4]_H0_L0.27_Fab Light Chain
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9231 - protein, 108 aa, Artificial Sequence; identical to SEQ ID NO: 6328
  Description of Artificial Sequence: Synthetic polypeptide
  VL of XENP019442

SEQ ID NO: 9232 - protein, 12 aa, Artificial Sequence
  Description of Artificial Sequence: Synthetic peptide
  XENP019442 vlCDR1
RASQSVGQSYLA

SEQ ID NO: 9233 - protein, 7 aa, Artificial Sequence
  Description of Artificial Sequence: Synthetic peptide
  XENP019442 vlCDR2
GAFSRAT

SEQ ID NO: 9234 - protein, 9 aa, Artificial Sequence
  Description of Artificial Sequence: Synthetic peptide
  XENP019442 vlCDR3
QQYGSSPWT

SEQ ID NO: 9235 - protein, 221 aa, Artificial Sequence; identical to SEQ ID NO: 7595
  Description of Artificial Sequence: Synthetic polypeptide
  XENP019443 [CTLA-4]_H0_L0.28_Fab Heavy Chain

SEQ ID NO: 9236 - protein, 118 aa, Artificial Sequence; identical to SEQ ID NO: 3737
  Description of Artificial Sequence: Synthetic polypeptide
  VH of XENP019443

SEQ ID NO: 9237 - protein, 5 aa, Artificial Sequence
  Description of Artificial Sequence: Synthetic peptide
  XENP019443 vhCDR1
SYTMH

SEQ ID NO: 9238 - protein, 17 aa, Artificial Sequence
  Description of Artificial Sequence: Synthetic peptide
  XENP019443 vhCDR2
FISYDGNNKYYADSVKG

SEQ ID NO: 9239 - protein, 9 aa, Artificial Sequence
  Description of Artificial Sequence: Synthetic peptide
  XENP019443 vhCDR3
TGWLGPFDY

SEQ ID NO: 9240 - protein, 215 aa, Artificial Sequence
  Description of Artificial Sequence: Synthetic polypeptide
  XENP019443 [CTLA-4]_H0_L0.28_Fab Light Chain
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9241 - protein, 108 aa, Artificial Sequence; identical to SEQ ID NO: 6337
  Description of Artificial Sequence: Synthetic polypeptide
  VL of XENP019443

SEQ ID NO: 9242 - protein, 12 aa, Artificial Sequence
  Description of Artificial Sequence: Synthetic peptide
  XENP019443 vlCDR1
RASQSVGTSYLA

SEQ ID NO: 9243 - protein, 7 aa, Artificial Sequence
  Description of Artificial Sequence: Synthetic peptide
  XENP019443 vlCDR2
GAFSRAT

SEQ ID NO: 9244 - protein, 9 aa, Artificial Sequence
  Description of Artificial Sequence: Synthetic peptide
  XENP019443 vlCDR3
QQYGSSPWT

SEQ ID NO: 9245 - protein, 221 aa, Artificial Sequence; identical to SEQ ID NO: 7595
  Description of Artificial Sequence: Synthetic polypeptide
  XENP019444 [CTLA-4]_H0_L0.29_Fab Heavy Chain

SEQ ID NO: 9246 - protein, 118 aa, Artificial Sequence; identical to SEQ ID NO: 3737
  Description of Artificial Sequence: Synthetic polypeptide
  VH of XENP019444

SEQ ID NO: 9247 - protein, 5 aa, Artificial Sequence
  Description of Artificial Sequence: Synthetic peptide
  XENP019444 vhCDR1
SYTMH

SEQ ID NO: 9248 - protein, 17 aa, Artificial Sequence
  Description of Artificial Sequence: Synthetic peptide
  XENP019444 vhCDR2
FISYDGNNKYYADSVKG

SEQ ID NO: 9249 - protein, 9 aa, Artificial Sequence
  Description of Artificial Sequence: Synthetic peptide
  XENP019444 vhCDR3
TGWLGPFDY

SEQ ID NO: 9250 - protein, 215 aa, Artificial Sequence
  Description of Artificial Sequence: Synthetic polypeptide
  XENP019444 [CTLA-4]_H0_L0.29_Fab Light Chain
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9251 - protein, 108 aa, Artificial Sequence; identical to SEQ ID NO: 6346
  Description of Artificial Sequence: Synthetic polypeptide
  VL of XENP019444

SEQ ID NO: 9252 - protein, 12 aa, Artificial Sequence
  Description of Artificial Sequence: Synthetic peptide
  XENP019444 vlCDR1
RASQSVGSAYLA

SEQ ID NO: 9253 - protein, 7 aa, Artificial Sequence
  Description of Artificial Sequence: Synthetic peptide
  XENP019444 vlCDR2
GAFSRAT

SEQ ID NO: 9254 - protein, 9 aa, Artificial Sequence
  Description of Artificial Sequence: Synthetic peptide
  XENP019444 vlCDR3
QQYGSSPWT

SEQ ID NO: 9255 - protein, 221 aa, Artificial Sequence; identical to SEQ ID NO: 7595
  Description of Artificial Sequence: Synthetic polypeptide
  XENP019445 [CTLA-4]_H0_L0.30_Fab Heavy Chain

SEQ ID NO: 9256 - protein, 118 aa, Artificial Sequence; identical to SEQ ID NO: 3737
  Description of Artificial Sequence: Synthetic polypeptide
  VH of XENP019445

SEQ ID NO: 9257 - protein, 5 aa, Artificial Sequence
  Description of Artificial Sequence: Synthetic peptide
  XENP019445 vhCDR1
SYTMH

SEQ ID NO: 9258 - protein, 17 aa, Artificial Sequence
  Description of Artificial Sequence: Synthetic peptide
  XENP019445 vhCDR2
FISYDGNNKYYADSVKG

SEQ ID NO: 9259 - protein, 9 aa, Artificial Sequence
  Description of Artificial Sequence: Synthetic peptide
  XENP019445 vhCDR3
TGWLGPFDY

SEQ ID NO: 9260 - protein, 215 aa, Artificial Sequence
  Description of Artificial Sequence: Synthetic polypeptide
  XENP019445 [CTLA-4]_H0_L0.30_Fab Light Chain
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9261 - protein, 108 aa, Artificial Sequence; identical to SEQ ID NO: 6355
  Description of Artificial Sequence: Synthetic polypeptide
  VL of XENP019445

SEQ ID NO: 9262 - protein, 12 aa, Artificial Sequence
  Description of Artificial Sequence: Synthetic peptide
  XENP019445 vlCDR1
RASQSVGSGYLA

SEQ ID NO: 9263 - protein, 7 aa, Artificial Sequence
  Description of Artificial Sequence: Synthetic peptide
  XENP019445 vlCDR2
GAFSRAT

SEQ ID NO: 9264 - protein, 9 aa, Artificial Sequence
  Description of Artificial Sequence: Synthetic peptide
  XENP019445 vlCDR3
QQYGSSPWT

SEQ ID NO: 9265 - protein, 221 aa, Artificial Sequence; identical to SEQ ID NO: 7595
  Description of Artificial Sequence: Synthetic polypeptide
  XENP019446 [CTLA-4]_H0_L0.31_Fab Heavy Chain

SEQ ID NO: 9266 - protein, 118 aa, Artificial Sequence; identical to SEQ ID NO: 3737
  Description of Artificial Sequence: Synthetic polypeptide
  VH of XENP019446

SEQ ID NO: 9267 - protein, 5 aa, Artificial Sequence
  Description of Artificial Sequence: Synthetic peptide
  XENP019446 vhCDR1
SYTMH

SEQ ID NO: 9268 - protein, 17 aa, Artificial Sequence
  Description of Artificial Sequence: Synthetic peptide
  XENP019446 vhCDR2
FISYDGNNKYYADSVKG

SEQ ID NO: 9269 - protein, 9 aa, Artificial Sequence
  Description of Artificial Sequence: Synthetic peptide
  XENP019446 vhCDR3
TGWLGPFDY

SEQ ID NO: 9270 - protein, 215 aa, Artificial Sequence
  Description of Artificial Sequence: Synthetic polypeptide
  XENP019446 [CTLA-4]_H0_L0.31_Fab Light Chain
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9271 - protein, 108 aa, Artificial Sequence; identical to SEQ ID NO: 6364
  Description of Artificial Sequence: Synthetic polypeptide
  VL of XENP019446

SEQ ID NO: 9272 - protein, 12 aa, Artificial Sequence
  Description of Artificial Sequence: Synthetic peptide
  XENP019446 vlCDR1
RASQSVGSNYLA

SEQ ID NO: 9273 - protein, 7 aa, Artificial Sequence
  Description of Artificial Sequence: Synthetic peptide
  XENP019446 vlCDR2
GAFSRAT

SEQ ID NO: 9274 - protein, 9 aa, Artificial Sequence
  Description of Artificial Sequence: Synthetic peptide
  XENP019446 vlCDR3
QQYGSSPWT

SEQ ID NO: 9275 - protein, 221 aa, Artificial Sequence; identical to SEQ ID NO: 7595
  Description of Artificial Sequence: Synthetic polypeptide
  XENP019447 [CTLA-4]_H0_L0.32_Fab Heavy Chain

SEQ ID NO: 9276 - protein, 118 aa, Artificial Sequence; identical to SEQ ID NO: 3737
  Description of Artificial Sequence: Synthetic polypeptide
  VH of XENP019447

SEQ ID NO: 9277 - protein, 5 aa, Artificial Sequence
  Description of Artificial Sequence: Synthetic peptide
  XENP019447 vhCDR1
SYTMH

SEQ ID NO: 9278 - protein, 17 aa, Artificial Sequence
  Description of Artificial Sequence: Synthetic peptide
  XENP019447 vhCDR2
FISYDGNNKYYADSVKG

SEQ ID NO: 9279 - protein, 9 aa, Artificial Sequence
  Description of Artificial Sequence: Synthetic peptide
  XENP019447 vhCDR3
TGWLGPFDY

SEQ ID NO: 9280 - protein, 215 aa, Artificial Sequence
  Description of Artificial Sequence: Synthetic polypeptide
  XENP019447 [CTLA-4]_H0_L0.32_Fab Light Chain
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9281 - protein, 108 aa, Artificial Sequence; identical to SEQ ID NO: 6373
  Description of Artificial Sequence: Synthetic polypeptide
  VL of XENP019447

SEQ ID NO: 9282 - protein, 12 aa, Artificial Sequence
  Description of Artificial Sequence: Synthetic peptide
  XENP019447 vlCDR1
RASQSVGSQYLA

SEQ ID NO: 9283 - protein, 7 aa, Artificial Sequence
  Description of Artificial Sequence: Synthetic peptide
  XENP019447 vlCDR2
GAFSRAT

SEQ ID NO: 9284 - protein, 9 aa, Artificial Sequence
  Description of Artificial Sequence: Synthetic peptide
  XENP019447 vlCDR3
QQYGSSPWT

SEQ ID NO: 9285 - protein, 221 aa, Artificial Sequence; identical to SEQ ID NO: 7595
  Description of Artificial Sequence: Synthetic polypeptide
  XENP019448 [CTLA-4]_H0_L0.33_Fab Heavy Chain

SEQ ID NO: 9286 - protein, 118 aa, Artificial Sequence; identical to SEQ ID NO: 3737
  Description of Artificial Sequence: Synthetic polypeptide
  VH of XENP019448

SEQ ID NO: 9287 - protein, 5 aa, Artificial Sequence
  Description of Artificial Sequence: Synthetic peptide
  XENP019448 vhCDR1
SYTMH

SEQ ID NO: 9288 - protein, 17 aa, Artificial Sequence
  Description of Artificial Sequence: Synthetic peptide
  XENP019448 vhCDR2
FISYDGNNKYYADSVKG

SEQ ID NO: 9289 - protein, 9 aa, Artificial Sequence
  Description of Artificial Sequence: Synthetic peptide
  XENP019448 vhCDR3
TGWLGPFDY

SEQ ID NO: 9290 - protein, 215 aa, Artificial Sequence
  Description of Artificial Sequence: Synthetic polypeptide
  XENP019448 [CTLA-4]_H0_L0.33_Fab Light Chain
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9291 - protein, 108 aa, Artificial Sequence; identical to SEQ ID NO: 6382
  Description of Artificial Sequence: Synthetic polypeptide
  VL of XENP019448

SEQ ID NO: 9292 - protein, 12 aa, Artificial Sequence
  Description of Artificial Sequence: Synthetic peptide
  XENP019448 vlCDR1
RASQSVGSTYLA

SEQ ID NO: 9293 - protein, 7 aa, Artificial Sequence
  Description of Artificial Sequence: Synthetic peptide
  XENP019448 vlCDR2
GAFSRAT

SEQ ID NO: 9294 - protein, 9 aa, Artificial Sequence
  Description of Artificial Sequence: Synthetic peptide
  XENP019448 vlCDR3
QQYGSSPWT

SEQ ID NO: 9295 - protein, 221 aa, Artificial Sequence; identical to SEQ ID NO: 7595
  Description of Artificial Sequence: Synthetic polypeptide
  XENP019449 [CTLA-4]_H0_L0.34_Fab Heavy Chain

SEQ ID NO: 9296 - protein, 118 aa, Artificial Sequence; identical to SEQ ID NO: 3737
  Description of Artificial Sequence: Synthetic polypeptide
  VH of XENP019449

SEQ ID NO: 9297 - protein, 5 aa, Artificial Sequence
  Description of Artificial Sequence: Synthetic peptide
  XENP019449 vhCDR1
SYTMH

SEQ ID NO: 9298 - protein, 17 aa, Artificial Sequence
  Description of Artificial Sequence: Synthetic peptide
  XENP019449 vhCDR2
FISYDGNNKYYADSVKG

SEQ ID NO: 9299 - protein, 9 aa, Artificial Sequence
  Description of Artificial Sequence: Synthetic peptide
  XENP019449 vhCDR3
TGWLGPFDY

SEQ ID NO: 9300 - protein, 215 aa, Artificial Sequence
  Description of Artificial Sequence: Synthetic polypeptide
  XENP019449 [CTLA-4]_H0_L0.34_Fab Light Chain
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9301 - protein, 108 aa, Artificial Sequence; identical to SEQ ID NO: 6391
  Description of Artificial Sequence: Synthetic polypeptide
  VL of XENP019449

SEQ ID NO: 9302 - protein, 12 aa, Artificial Sequence
  Description of Artificial Sequence: Synthetic peptide
  XENP019449 vlCDR1
RASQSVGSSALA

SEQ ID NO: 9303 - protein, 7 aa, Artificial Sequence
  Description of Artificial Sequence: Synthetic peptide
  XENP019449 vlCDR2
GAFSRAT

SEQ ID NO: 9304 - protein, 9 aa, Artificial Sequence
  Description of Artificial Sequence: Synthetic peptide
  XENP019449 vlCDR3
QQYGSSPWT

SEQ ID NO: 9305 - protein, 221 aa, Artificial Sequence; identical to SEQ ID NO: 7595
  Description of Artificial Sequence: Synthetic polypeptide
  XENP019450 [CTLA-4]_H0_L0.35_Fab Heavy Chain

SEQ ID NO: 9306 - protein, 118 aa, Artificial Sequence; identical to SEQ ID NO: 3737
  Description of Artificial Sequence: Synthetic polypeptide
  VH of XENP019450

SEQ ID NO: 9307 - protein, 5 aa, Artificial Sequence
  Description of Artificial Sequence: Synthetic peptide
  XENP019450 vhCDR1
SYTMH

SEQ ID NO: 9308 - protein, 17 aa, Artificial Sequence
  Description of Artificial Sequence: Synthetic peptide
  XENP019450 vhCDR2
FISYDGNNKYYADSVKG

SEQ ID NO: 9309 - protein, 9 aa, Artificial Sequence
  Description of Artificial Sequence: Synthetic peptide
  XENP019450 vhCDR3
TGWLGPFDY

SEQ ID NO: 9310 - protein, 215 aa, Artificial Sequence
  Description of Artificial Sequence: Synthetic polypeptide
  XENP019450 [CTLA-4]_H0_L0.35_Fab Light Chain
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9311 - protein, 108 aa, Artificial Sequence; identical to SEQ ID NO: 6400
  Description of Artificial Sequence: Synthetic polypeptide
  VL of XENP019450

SEQ ID NO: 9312 - protein, 12 aa, Artificial Sequence
  Description of Artificial Sequence: Synthetic peptide
  XENP019450 vlCDR1
RASQSVGSSFLA

SEQ ID NO: 9313 - protein, 7 aa, Artificial Sequence
  Description of Artificial Sequence: Synthetic peptide
  XENP019450 vlCDR2
GAFSRAT

SEQ ID NO: 9314 - protein, 9 aa, Artificial Sequence
  Description of Artificial Sequence: Synthetic peptide
  XENP019450 vlCDR3
QQYGSSPWT

SEQ ID NO: 9315 - protein, 221 aa, Artificial Sequence; identical to SEQ ID NO: 7595
  Description of Artificial Sequence: Synthetic polypeptide
  XENP019451 [CTLA-4]_H0_L0.36_Fab Heavy Chain

SEQ ID NO: 9316 - protein, 118 aa, Artificial Sequence; identical to SEQ ID NO: 3737
  Description of Artificial Sequence: Synthetic polypeptide
  VH of XENP019451

SEQ ID NO: 9317 - protein, 5 aa, Artificial Sequence
  Description of Artificial Sequence: Synthetic peptide
  XENP019451 vhCDR1
SYTMH

SEQ ID NO: 9318 - protein, 17 aa, Artificial Sequence
  Description of Artificial Sequence: Synthetic peptide
  XENP019451 vhCDR2
FISYDGNNKYYADSVKG

SEQ ID NO: 9319 - protein, 9 aa, Artificial Sequence
  Description of Artificial Sequence: Synthetic peptide
  XENP019451 vhCDR3
TGWLGPFDY

SEQ ID NO: 9320 - protein, 215 aa, Artificial Sequence
  Description of Artificial Sequence: Synthetic polypeptide
  XENP019451 [CTLA-4]_H0_L0.36_Fab Light Chain
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9321 - protein, 108 aa, Artificial Sequence; identical to SEQ ID NO: 6409
  Description of Artificial Sequence: Synthetic polypeptide
  VL of XENP019451

SEQ ID NO: 9322 - protein, 12 aa, Artificial Sequence
  Description of Artificial Sequence: Synthetic peptide
  XENP019451 vlCDR1
RASQSVGSSHLA

SEQ ID NO: 9323 - protein, 7 aa, Artificial Sequence
  Description of Artificial Sequence: Synthetic peptide
  XENP019451 vlCDR2
GAFSRAT

SEQ ID NO: 9324 - protein, 9 aa, Artificial Sequence
  Description of Artificial Sequence: Synthetic peptide
  XENP019451 vlCDR3
QQYGSSPWT

SEQ ID NO: 9325 - protein, 221 aa, Artificial Sequence; identical to SEQ ID NO: 7595
  Description of Artificial Sequence: Synthetic polypeptide
  XENP019452 [CTLA-4]_H0_L0.37_Fab Heavy Chain

SEQ ID NO: 9326 - protein, 118 aa, Artificial Sequence; identical to SEQ ID NO: 3737
  Description of Artificial Sequence: Synthetic polypeptide
  VH of XENP019452

SEQ ID NO: 9327 - protein, 5 aa, Artificial Sequence
  Description of Artificial Sequence: Synthetic peptide
  XENP019452 vhCDR1
SYTMH

SEQ ID NO: 9328 - protein, 17 aa, Artificial Sequence
  Description of Artificial Sequence: Synthetic peptide
  XENP019452 vhCDR2
FISYDGNNKYYADSVKG

SEQ ID NO: 9329 - protein, 9 aa, Artificial Sequence
  Description of Artificial Sequence: Synthetic peptide
  XENP019452 vhCDR3
TGWLGPFDY

SEQ ID NO: 9330 - protein, 215 aa, Artificial Sequence
  Description of Artificial Sequence: Synthetic polypeptide
  XENP019452 [CTLA-4]_H0_L0.37_Fab Light Chain
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9331 - protein, 108 aa, Artificial Sequence; identical to SEQ ID NO: 6418
  Description of Artificial Sequence: Synthetic polypeptide
  VL of XENP019452

SEQ ID NO: 9332 - protein, 12 aa, Artificial Sequence
  Description of Artificial Sequence: Synthetic peptide
  XENP019452 vlCDR1
RASQSVGSSLLA

SEQ ID NO: 9333 - protein, 7 aa, Artificial Sequence
  Description of Artificial Sequence: Synthetic peptide
  XENP019452 vlCDR2
GAFSRAT

SEQ ID NO: 9334 - protein, 9 aa, Artificial Sequence
  Description of Artificial Sequence: Synthetic peptide
  XENP019452 vlCDR3
QQYGSSPWT

SEQ ID NO: 9335 - protein, 221 aa, Artificial Sequence; identical to SEQ ID NO: 7595
  Description of Artificial Sequence: Synthetic polypeptide
  XENP019453 [CTLA-4]_H0_L0.38_Fab Heavy Chain

SEQ ID NO: 9336 - protein, 118 aa, Artificial Sequence; identical to SEQ ID NO: 3737
  Description of Artificial Sequence: Synthetic polypeptide
  VH of XENP019453

SEQ ID NO: 9337 - protein, 5 aa, Artificial Sequence
  Description of Artificial Sequence: Synthetic peptide
  XENP019453 vhCDR1
SYTMH

SEQ ID NO: 9338 - protein, 17 aa, Artificial Sequence
  Description of Artificial Sequence: Synthetic peptide
  XENP019453 vhCDR2
FISYDGNNKYYADSVKG

SEQ ID NO: 9339 - protein, 9 aa, Artificial Sequence
  Description of Artificial Sequence: Synthetic peptide
  XENP019453 vhCDR3
TGWLGPFDY

SEQ ID NO: 9340 - protein, 215 aa, Artificial Sequence
  Description of Artificial Sequence: Synthetic polypeptide
  XENP019453 [CTLA-4]_H0_L0.38_Fab Light Chain
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9341 - protein, 108 aa, Artificial Sequence; identical to SEQ ID NO: 6427
  Description of Artificial Sequence: Synthetic polypeptide
  VL of XENP019453

SEQ ID NO: 9342 - protein, 12 aa, Artificial Sequence
  Description of Artificial Sequence: Synthetic peptide
  XENP019453 vlCDR1
RASQSVGSSNLA

SEQ ID NO: 9343 - protein, 7 aa, Artificial Sequence
  Description of Artificial Sequence: Synthetic peptide
  XENP019453 vlCDR2
GAFSRAT

SEQ ID NO: 9344 - protein, 9 aa, Artificial Sequence
  Description of Artificial Sequence: Synthetic peptide
  XENP019453 vlCDR3
QQYGSSPWT

SEQ ID NO: 9345 - protein, 221 aa, Artificial Sequence; identical to SEQ ID NO: 7595
  Description of Artificial Sequence: Synthetic polypeptide
  XENP019454 [CTLA-4]_H0_L0.39_Fab Heavy Chain

SEQ ID NO: 9346 - protein, 118 aa, Artificial Sequence; identical to SEQ ID NO: 3737
  Description of Artificial Sequence: Synthetic polypeptide
  VH of XENP019454

SEQ ID NO: 9347 - protein, 5 aa, Artificial Sequence
  Description of Artificial Sequence: Synthetic peptide
  XENP019454 vhCDR1
SYTMH

SEQ ID NO: 9348 - protein, 17 aa, Artificial Sequence
  Description of Artificial Sequence: Synthetic peptide
  XENP019454 vhCDR2
FISYDGNNKYYADSVKG

SEQ ID NO: 9349 - protein, 9 aa, Artificial Sequence
  Description of Artificial Sequence: Synthetic peptide
  XENP019454 vhCDR3
TGWLGPFDY

SEQ ID NO: 9350 - protein, 215 aa, Artificial Sequence
  Description of Artificial Sequence: Synthetic polypeptide
  XENP019454 [CTLA-4]_H0_L0.39_Fab Light Chain
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9351 - protein, 108 aa, Artificial Sequence; identical to SEQ ID NO: 6436
  Description of Artificial Sequence: Synthetic polypeptide
  VL of XENP019454

SEQ ID NO: 9352 - protein, 12 aa, Artificial Sequence
  Description of Artificial Sequence: Synthetic peptide
  XENP019454 vlCDR1
RASQSVGSSSLA

SEQ ID NO: 9353 - protein, 7 aa, Artificial Sequence
  Description of Artificial Sequence: Synthetic peptide
  XENP019454 vlCDR2
GAFSRAT

SEQ ID NO: 9354 - protein, 9 aa, Artificial Sequence
  Description of Artificial Sequence: Synthetic peptide
  XENP019454 vlCDR3
QQYGSSPWT

SEQ ID NO: 9355 - protein, 221 aa, Artificial Sequence; identical to SEQ ID NO: 7595
  Description of Artificial Sequence: Synthetic polypeptide
  XENP019455 [CTLA-4]_H0_L0.40_Fab Heavy Chain

SEQ ID NO: 9356 - protein, 118 aa, Artificial Sequence; identical to SEQ ID NO: 3737
  Description of Artificial Sequence: Synthetic polypeptide
  VH of XENP019455

SEQ ID NO: 9357 - protein, 5 aa, Artificial Sequence
  Description of Artificial Sequence: Synthetic peptide
  XENP019455 vhCDR1
SYTMH

SEQ ID NO: 9358 - protein, 17 aa, Artificial Sequence
  Description of Artificial Sequence: Synthetic peptide
  XENP019455 vhCDR2
FISYDGNNKYYADSVKG

SEQ ID NO: 9359 - protein, 9 aa, Artificial Sequence
  Description of Artificial Sequence: Synthetic peptide
  XENP019455 vhCDR3
TGWLGPFDY

SEQ ID NO: 9360 - protein, 215 aa, Artificial Sequence
  Description of Artificial Sequence: Synthetic polypeptide
  XENP019455 [CTLA-4]_H0_L0.40_Fab Light Chain
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9361 - protein, 108 aa, Artificial Sequence; identical to SEQ ID NO: 6445
  Description of Artificial Sequence: Synthetic polypeptide
  VL of XENP019455

SEQ ID NO: 9362 - protein, 12 aa, Artificial Sequence
  Description of Artificial Sequence: Synthetic peptide
  XENP019455 vlCDR1
RASQSVGSSVLA

SEQ ID NO: 9363 - protein, 7 aa, Artificial Sequence
  Description of Artificial Sequence: Synthetic peptide
  XENP019455 vlCDR2
GAFSRAT

SEQ ID NO: 9364 - protein, 9 aa, Artificial Sequence
  Description of Artificial Sequence: Synthetic peptide
  XENP019455 vlCDR3
QQYGSSPWT

SEQ ID NO: 9365 - protein, 221 aa, Artificial Sequence; identical to SEQ ID NO: 7595
  Description of Artificial Sequence: Synthetic polypeptide
  XENP019456 [CTLA-4]_H0_L0.41_Fab Heavy Chain

SEQ ID NO: 9366 - protein, 118 aa, Artificial Sequence; identical to SEQ ID NO: 3737
  Description of Artificial Sequence: Synthetic polypeptide
  VH of XENP019456

SEQ ID NO: 9367 - protein, 5 aa, Artificial Sequence
  Description of Artificial Sequence: Synthetic peptide
  XENP019456 vhCDR1
SYTMH

SEQ ID NO: 9368 - protein, 17 aa, Artificial Sequence
  Description of Artificial Sequence: Synthetic peptide
  XENP019456 vhCDR2
FISYDGNNKYYADSVKG

SEQ ID NO: 9369 - protein, 9 aa, Artificial Sequence
  Description of Artificial Sequence: Synthetic peptide
  XENP019456 vhCDR3
TGWLGPFDY

SEQ ID NO: 9370 - protein, 215 aa, Artificial Sequence
  Description of Artificial Sequence: Synthetic polypeptide
  XENP019456 [CTLA-4]_H0_L0.41_Fab Light Chain
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9371 - protein, 108 aa, Artificial Sequence; identical to SEQ ID NO: 6454
  Description of Artificial Sequence: Synthetic polypeptide
  VL of XENP019456

SEQ ID NO: 9372 - protein, 12 aa, Artificial Sequence
  Description of Artificial Sequence: Synthetic peptide
  XENP019456 vlCDR1
RASQSVGSSYMA

SEQ ID NO: 9373 - protein, 7 aa, Artificial Sequence
  Description of Artificial Sequence: Synthetic peptide
  XENP019456 vlCDR2
GAFSRAT

SEQ ID NO: 9374 - protein, 9 aa, Artificial Sequence
  Description of Artificial Sequence: Synthetic peptide
  XENP019456 vlCDR3
QQYGSSPWT

SEQ ID NO: 9375 - protein, 221 aa, Artificial Sequence; identical to SEQ ID NO: 7595
  Description of Artificial Sequence: Synthetic polypeptide
  XENP019457 [CTLA-4]_H0_L0.42_Fab Heavy Chain

SEQ ID NO: 9376 - protein, 118 aa, Artificial Sequence; identical to SEQ ID NO: 3737
  Description of Artificial Sequence: Synthetic polypeptide
  VH of XENP019457

SEQ ID NO: 9377 - protein, 5 aa, Artificial Sequence
  Description of Artificial Sequence: Synthetic peptide
  XENP019457 vhCDR1
SYTMH

SEQ ID NO: 9378 - protein, 17 aa, Artificial Sequence
  Description of Artificial Sequence: Synthetic peptide
  XENP019457 vhCDR2
FISYDGNNKYYADSVKG

SEQ ID NO: 9379 - protein, 9 aa, Artificial Sequence
  Description of Artificial Sequence: Synthetic peptide
  XENP019457 vhCDR3
TGWLGPFDY

SEQ ID NO: 9380 - protein, 215 aa, Artificial Sequence
  Description of Artificial Sequence: Synthetic polypeptide
  XENP019457 [CTLA-4]_H0_L0.42_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9381 - protein, 108 aa, Artificial Sequence; identical to SEQ ID NO: 6463
  Description of Artificial Sequence: Synthetic polypeptide
  VL of XENP019457

SEQ ID NO: 9382 - protein, 12 aa, Artificial Sequence
  Description of Artificial Sequence: Synthetic peptide
  XENP019457 vlCDR1
RASQSVGSSYLD

SEQ ID NO: 9383 - protein, 7 aa, Artificial Sequence
  Description of Artificial Sequence: Synthetic peptide
  XENP019457 vlCDR2
GAFSRAT

SEQ ID NO: 9384 - protein, 9 aa, Artificial Sequence
  Description of Artificial Sequence: Synthetic peptide
  XENP019457 vlCDR3
QQYGSSPWT

SEQ ID NO: 9385 - protein, 221 aa, Artificial Sequence; identical to SEQ ID NO: 7595
  Description of Artificial Sequence: Synthetic polypeptide
  XENP019458 [CTLA-4]_H0_L0.43_Fab Heavy Chain

SEQ ID NO: 9386 - protein, 118 aa, Artificial Sequence; identical to SEQ ID NO: 3737
  Description of Artificial Sequence: Synthetic polypeptide
  VH of XENP019458

SEQ ID NO: 9387 - protein, 5 aa, Artificial Sequence
  Description of Artificial Sequence: Synthetic peptide
  XENP019458 vhCDR1
SYTMH

SEQ ID NO: 9388 - protein, 17 aa, Artificial Sequence
  Description of Artificial Sequence: Synthetic peptide
  XENP019458 vhCDR2
FISYDGNNKYYADSVKG

SEQ ID NO: 9389 - protein, 9 aa, Artificial Sequence
  Description of Artificial Sequence: Synthetic peptide
  XENP019458 vhCDR3
TGWLGPFDY

SEQ ID NO: 9390 - protein, 215 aa, Artificial Sequence
  Description of Artificial Sequence: Synthetic polypeptide
  XENP019458 [CTLA-4]_H0_L0.43_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9391 - protein, 108 aa, Artificial Sequence; identical to SEQ ID NO: 6472
  Description of Artificial Sequence: Synthetic polypeptide
  VL of XENP019458

SEQ ID NO: 9392 - protein, 12 aa, Artificial Sequence
  Description of Artificial Sequence: Synthetic peptide
  XENP019458 vlCDR1
RASQSVGSSYLD

SEQ ID NO: 9393 - protein, 7 aa, Artificial Sequence
  Description of Artificial Sequence: Synthetic peptide
  XENP019458 vlCDR2
GAFSRAT

SEQ ID NO: 9394 - protein, 9 aa, Artificial Sequence
  Description of Artificial Sequence: Synthetic peptide
  XENP019458 vlCDR3
KQYGSSPWT

SEQ ID NO: 9395 - protein, 221 aa, Artificial Sequence; identical to SEQ ID NO: 7595
  Description of Artificial Sequence: Synthetic polypeptide
  XENP019459 [CTLA-4]_H0_L0.44_Fab Heavy Chain

SEQ ID NO: 9396 - protein, 118 aa, Artificial Sequence; identical to SEQ ID NO: 3737
  Description of Artificial Sequence: Synthetic polypeptide
  VH of XENP019459

SEQ ID NO: 9397 - protein, 5 aa, Artificial Sequence
  Description of Artificial Sequence: Synthetic peptide
  XENP019459 vhCDR1
SYTMH

SEQ ID NO: 9398 - protein, 17 aa, Artificial Sequence
  Description of Artificial Sequence: Synthetic peptide
  XENP019459 vhCDR2
FISYDGNNKYYADSVKG

SEQ ID NO: 9399 - protein, 9 aa, Artificial Sequence
  Description of Artificial Sequence: Synthetic peptide
  XENP019459 vhCDR3
TGWLGPFDY

SEQ ID NO: 9400 - protein, 215 aa, Artificial Sequence
  Description of Artificial Sequence: Synthetic polypeptide
  XENP019459 [CTLA-4]_H0_L0.44_Fab Light Chain
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9401 - protein, 108 aa, Artificial Sequence; identical to SEQ ID NO: 6481
  Description of Artificial Sequence: Synthetic polypeptide
  VL of XENP019459

SEQ ID NO: 9402 - protein, 12 aa, Artificial Sequence
  Description of Artificial Sequence: Synthetic peptide
  XENP019459 vlCDR1
RASQSVGSSYLS

SEQ ID NO: 9403 - protein, 7 aa, Artificial Sequence
  Description of Artificial Sequence: Synthetic peptide
  XENP019459 vlCDR2
GAFSRAT

SEQ ID NO: 9404 - protein, 9 aa, Artificial Sequence
  Description of Artificial Sequence: Synthetic peptide
  XENP019459 vlCDR3
QQYGSSPWT

SEQ ID NO: 9405 - protein, 221 aa, Artificial Sequence; identical to SEQ ID NO: 7595
  Description of Artificial Sequence: Synthetic polypeptide
  XENP019460 [CTLA-4]_H0_L0.45_Fab Heavy Chain

SEQ ID NO: 9406 - protein, 118 aa, Artificial Sequence; identical to SEQ ID NO: 3737
  Description of Artificial Sequence: Synthetic polypeptide
  VH of XENP019460

SEQ ID NO: 9407 - protein, 5 aa, Artificial Sequence
  Description of Artificial Sequence: Synthetic peptide
  XENP019460 vhCDR1
SYTMH

SEQ ID NO: 9408 - protein, 17 aa, Artificial Sequence
  Description of Artificial Sequence: Synthetic peptide
  XENP019460 vhCDR2
FISYDGNNKYYADSVKG

SEQ ID NO: 9409 - protein, 9 aa, Artificial Sequence
  Description of Artificial Sequence: Synthetic peptide
  XENP019460 vhCDR3
TGWLGPFDY

SEQ ID NO: 9410 - protein, 215 aa, Artificial Sequence
  Description of Artificial Sequence: Synthetic polypeptide
  XENP019460 [CTLA-4]_H0_L0.45_Fab Light Chain
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9411 - protein, 108 aa, Artificial Sequence; identical to SEQ ID NO: 6490
  Description of Artificial Sequence: Synthetic polypeptide
  VL of XENP019460

SEQ ID NO: 9412 - protein, 12 aa, Artificial Sequence
  Description of Artificial Sequence: Synthetic peptide
  XENP019460 vlCDR1
RASQSVGSSYLT

SEQ ID NO: 9413 - protein, 7 aa, Artificial Sequence
  Description of Artificial Sequence: Synthetic peptide
  XENP019460 vlCDR2
GAFSRAT

SEQ ID NO: 9414 - protein, 9 aa, Artificial Sequence
  Description of Artificial Sequence: Synthetic peptide
  XENP019460 vlCDR3
QQYGSSPWT

SEQ ID NO: 9415 - protein, 221 aa, Artificial Sequence; identical to SEQ ID NO: 7595
  Description of Artificial Sequence: Synthetic polypeptide
  XENP019461 [CTLA-4]_H0_L0.46_Fab Heavy Chain

SEQ ID NO: 9416 - protein, 118 aa, Artificial Sequence; identical to SEQ ID NO: 3737
  Description of Artificial Sequence: Synthetic polypeptide
  VH of XENP019461

SEQ ID NO: 9417 - protein, 5 aa, Artificial Sequence
  Description of Artificial Sequence: Synthetic peptide
  XENP019461 vhCDR1
SYTMH

SEQ ID NO: 9418 - protein, 17 aa, Artificial Sequence
  Description of Artificial Sequence: Synthetic peptide
  XENP019461 vhCDR2
FISYDGNNKYYADSVKG

SEQ ID NO: 9419 - protein, 9 aa, Artificial Sequence
  Description of Artificial Sequence: Synthetic peptide
  XENP019461 vhCDR3
TGWLGPFDY

SEQ ID NO: 9420 - protein, 215 aa, Artificial Sequence
  Description of Artificial Sequence: Synthetic polypeptide
  XENP019461 [CTLA-4]_H0_L0.46_Fab Light Chain
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9421 - protein, 108 aa, Artificial Sequence; identical to SEQ ID NO: 6499
  Description of Artificial Sequence: Synthetic polypeptide
  VL of XENP019461

SEQ ID NO: 9422 - protein, 12 aa, Artificial Sequence
  Description of Artificial Sequence: Synthetic peptide
  XENP019461 vlCDR1
RASQSVGSSYLA

SEQ ID NO: 9423 - protein, 7 aa, Artificial Sequence
  Description of Artificial Sequence: Synthetic peptide
  XENP019461 vlCDR2
GAFSRAT

SEQ ID NO: 9424 - protein, 9 aa, Artificial Sequence
  Description of Artificial Sequence: Synthetic peptide
  XENP019461 vlCDR3
QQYGSSPWT

SEQ ID NO: 9425 - protein, 221 aa, Artificial Sequence; identical to SEQ ID NO: 7595
  Description of Artificial Sequence: Synthetic polypeptide
  XENP019462 [CTLA-4]_H0_L0.47_Fab Heavy Chain

SEQ ID NO: 9426 - protein, 118 aa, Artificial Sequence; identical to SEQ ID NO: 3737
  Description of Artificial Sequence: Synthetic polypeptide
  VH of XENP019462

SEQ ID NO: 9427 - protein, 5 aa, Artificial Sequence
  Description of Artificial Sequence: Synthetic peptide
  XENP019462 vhCDR1
SYTMH

SEQ ID NO: 9428 - protein, 17 aa, Artificial Sequence
  Description of Artificial Sequence: Synthetic peptide
  XENP019462 vhCDR2
FISYDGNNKYYADSVKG

SEQ ID NO: 9429 - protein, 9 aa, Artificial Sequence
  Description of Artificial Sequence: Synthetic peptide
  XENP019462 vhCDR3
TGWLGPFDY

SEQ ID NO: 9430 - protein, 215 aa, Artificial Sequence
  Description of Artificial Sequence: Synthetic polypeptide
  XENP019462 [CTLA-4]_H0_L0.47_Fab Light Chain
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9431 - protein, 108 aa, Artificial Sequence; identical to SEQ ID NO: 6508
  Description of Artificial Sequence: Synthetic polypeptide
  VL of XENP019462

SEQ ID NO: 9432 - protein, 12 aa, Artificial Sequence
  Description of Artificial Sequence: Synthetic peptide
  XENP019462 vlCDR1
RASQSVGSSYLA

SEQ ID NO: 9433 - protein, 7 aa, Artificial Sequence
  Description of Artificial Sequence: Synthetic peptide
  XENP019462 vlCDR2
GAFSRAT

SEQ ID NO: 9434 - protein, 9 aa, Artificial Sequence
  Description of Artificial Sequence: Synthetic peptide
  XENP019462 vlCDR3
QQYGSSPWT

SEQ ID NO: 9435 - protein, 221 aa, Artificial Sequence; identical to SEQ ID NO: 7595
  Description of Artificial Sequence: Synthetic polypeptide
  XENP019463 [CTLA-4]_H0_L0.48_Fab Heavy Chain

SEQ ID NO: 9436 - protein, 118 aa, Artificial Sequence; identical to SEQ ID NO: 3737
  Description of Artificial Sequence: Synthetic polypeptide
  VH of XENP019463

SEQ ID NO: 9437 - protein, 5 aa, Artificial Sequence
  Description of Artificial Sequence: Synthetic peptide
  XENP019463 vhCDR1
SYTMH

SEQ ID NO: 9438 - protein, 17 aa, Artificial Sequence
  Description of Artificial Sequence: Synthetic peptide
  XENP019463 vhCDR2
FISYDGNNKYYADSVKG

SEQ ID NO: 9439 - protein, 9 aa, Artificial Sequence
  Description of Artificial Sequence: Synthetic peptide
  XENP019463 vhCDR3
TGWLGPFDY

SEQ ID NO: 9440 - protein, 215 aa, Artificial Sequence
  Description of Artificial Sequence: Synthetic polypeptide
  XENP019463 [CTLA-4]_H0_L0.48_Fab Light Chain
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9441 - protein, 108 aa, Artificial Sequence; identical to SEQ ID NO: 6517
  Description of Artificial Sequence: Synthetic polypeptide
  VL of XENP019463

SEQ ID NO: 9442 - protein, 12 aa, Artificial Sequence
  Description of Artificial Sequence: Synthetic peptide
  XENP019463 vlCDR1
RASQSVGSSYLA

SEQ ID NO: 9443 - protein, 7 aa, Artificial Sequence
  Description of Artificial Sequence: Synthetic peptide
  XENP019463 vlCDR2
GAFSRAT

SEQ ID NO: 9444 - protein, 9 aa, Artificial Sequence
  Description of Artificial Sequence: Synthetic peptide
  XENP019463 vlCDR3
QQYGSSPWT

SEQ ID NO: 9445 - protein, 221 aa, Artificial Sequence; identical to SEQ ID NO: 7595
  Description of Artificial Sequence: Synthetic polypeptide
  XENP019464 [CTLA-4]_H0_L0.49_Fab Heavy Chain

SEQ ID NO: 9446 - protein, 118 aa, Artificial Sequence; identical to SEQ ID NO: 3737
  Description of Artificial Sequence: Synthetic polypeptide
  VH of XENP019464

SEQ ID NO: 9447 - protein, 5 aa, Artificial Sequence
  Description of Artificial Sequence: Synthetic peptide
  XENP019464 vhCDR1
SYTMH

SEQ ID NO: 9448 - protein, 17 aa, Artificial Sequence
  Description of Artificial Sequence: Synthetic peptide
  XENP019464 vhCDR2
FISYDGNNKYYADSVKG

SEQ ID NO: 9449 - protein, 9 aa, Artificial Sequence
  Description of Artificial Sequence: Synthetic peptide
  XENP019464 vhCDR3
TGWLGPFDY

SEQ ID NO: 9450 - protein, 215 aa, Artificial Sequence
  Description of Artificial Sequence: Synthetic polypeptide
  XENP019464 [CTLA-4]_H0_L0.49_Fab Light Chain
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9451 - protein, 108 aa, Artificial Sequence; identical to SEQ ID NO: 6526
  Description of Artificial Sequence: Synthetic polypeptide
  VL of XENP019464

SEQ ID NO: 9452 - protein, 12 aa, Artificial Sequence
  Description of Artificial Sequence: Synthetic peptide
  XENP019464 vlCDR1
RASQSVGSSYLA

SEQ ID NO: 9453 - protein, 7 aa, Artificial Sequence
  Description of Artificial Sequence: Synthetic peptide
  XENP019464 vlCDR2
GAFSRAT

SEQ ID NO: 9454 - protein, 9 aa, Artificial Sequence
  Description of Artificial Sequence: Synthetic peptide
  XENP019464 vlCDR3
QQYGSSPWT

SEQ ID NO: 9455 - protein, 221 aa, Artificial Sequence; identical to SEQ ID NO: 7595
  Description of Artificial Sequence: Synthetic polypeptide
  XENP019465 [CTLA-4]_H0_L0.50_Fab Heavy Chain

SEQ ID NO: 9456 - protein, 118 aa, Artificial Sequence; identical to SEQ ID NO: 3737
  Description of Artificial Sequence: Synthetic polypeptide
  VH of XENP019465

SEQ ID NO: 9457 - protein, 5 aa, Artificial Sequence
  Description of Artificial Sequence: Synthetic peptide
  XENP019465 vhCDR1
SYTMH

SEQ ID NO: 9458 - protein, 17 aa, Artificial Sequence
  Description of Artificial Sequence: Synthetic peptide
  XENP019465 vhCDR2
FISYDGNNKYYADSVKG

SEQ ID NO: 9459 - protein, 9 aa, Artificial Sequence
  Description of Artificial Sequence: Synthetic peptide
  XENP019465 vhCDR3
TGWLGPFDY

SEQ ID NO: 9460 - protein, 215 aa, Artificial Sequence
  Description of Artificial Sequence: Synthetic polypeptide
  XENP019465 [CTLA-4]_H0_L0.50_Fab Light Chain
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9461 - protein, 108 aa, Artificial Sequence; identical to SEQ ID NO: 4708
  Description of Artificial Sequence: Synthetic polypeptide
  VL of XENP019465

SEQ ID NO: 9462 - protein, 12 aa, Artificial Sequence
  Description of Artificial Sequence: Synthetic peptide
  XENP019465 vlCDR1
RASQSVGSSYLA

SEQ ID NO: 9463 - protein, 7 aa, Artificial Sequence
  Description of Artificial Sequence: Synthetic peptide
  XENP019465 vlCDR2
GAFSRAT

SEQ ID NO: 9464 - protein, 9 aa, Artificial Sequence
  Description of Artificial Sequence: Synthetic peptide
  XENP019465 vlCDR3
QQYGSSPWT

SEQ ID NO: 9465 - protein, 221 aa, Artificial Sequence; identical to SEQ ID NO: 7595
  Description of Artificial Sequence: Synthetic polypeptide
  XENP019466 [CTLA-4]_H0_L0.51_Fab Heavy Chain

SEQ ID NO: 9466 - protein, 118 aa, Artificial Sequence; identical to SEQ ID NO: 3737
  Description of Artificial Sequence: Synthetic polypeptide
  VH of XENP019466

SEQ ID NO: 9467 - protein, 5 aa, Artificial Sequence
  Description of Artificial Sequence: Synthetic peptide
  XENP019466 vhCDR1
SYTMH

SEQ ID NO: 9468 - protein, 17 aa, Artificial Sequence
  Description of Artificial Sequence: Synthetic peptide
  XENP019466 vhCDR2
FISYDGNNKYYADSVKG

SEQ ID NO: 9469 - protein, 9 aa, Artificial Sequence
  Description of Artificial Sequence: Synthetic peptide
  XENP019466 vhCDR3
TGWLGPFDY

SEQ ID NO: 9470 - protein, 215 aa, Artificial Sequence
  Description of Artificial Sequence: Synthetic polypeptide
  XENP019466 [CTLA-4]_H0_L0.51_Fab Light Chain
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9471 - protein, 108 aa, Artificial Sequence; identical to SEQ ID NO: 4717
  Description of Artificial Sequence: Synthetic polypeptide
  VL of XENP019466

SEQ ID NO: 9472 - protein, 12 aa, Artificial Sequence
  Description of Artificial Sequence: Synthetic peptide
  XENP019466 vlCDR1
RASQSVGSSYLA

SEQ ID NO: 9473 - protein, 7 aa, Artificial Sequence
  Description of Artificial Sequence: Synthetic peptide
  XENP019466 vlCDR2
GAFSRAT

SEQ ID NO: 9474 - protein, 9 aa, Artificial Sequence
  Description of Artificial Sequence: Synthetic peptide
  XENP019466 vlCDR3
QQYGSSPWT

SEQ ID NO: 9475 - protein, 221 aa, Artificial Sequence; identical to SEQ ID NO: 7595
  Description of Artificial Sequence: Synthetic polypeptide
  XENP019467 [CTLA-4]_H0_L0.52_Fab Heavy Chain

SEQ ID NO: 9476 - protein, 118 aa, Artificial Sequence; identical to SEQ ID NO: 3737
  Description of Artificial Sequence: Synthetic polypeptide
  VH of XENP019467

SEQ ID NO: 9477 - protein, 5 aa, Artificial Sequence
  Description of Artificial Sequence: Synthetic peptide
  XENP019467 vhCDR1
SYTMH

SEQ ID NO: 9478 - protein, 17 aa, Artificial Sequence
  Description of Artificial Sequence: Synthetic peptide
  XENP019467 vhCDR2
FISYDGNNKYYADSVKG

SEQ ID NO: 9479 - protein, 9 aa, Artificial Sequence
  Description of Artificial Sequence: Synthetic peptide
  XENP019467 vhCDR3
TGWLGPFDY

SEQ ID NO: 9480 - protein, 215 aa, Artificial Sequence
  Description of Artificial Sequence: Synthetic polypeptide
  XENP019467 [CTLA-4]_H0_L0.52_Fab Light Chain
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9481 - protein, 108 aa, Artificial Sequence; identical to SEQ ID NO: 6553
  Description of Artificial Sequence: Synthetic polypeptide
  VL of XENP019467

SEQ ID NO: 9482 - protein, 12 aa, Artificial Sequence
  Description of Artificial Sequence: Synthetic peptide
  XENP019467 vlCDR1
RASQSVGSSYLA

SEQ ID NO: 9483 - protein, 7 aa, Artificial Sequence
  Description of Artificial Sequence: Synthetic peptide
  XENP019467 vlCDR2
GAFSRAT

SEQ ID NO: 9484 - protein, 9 aa, Artificial Sequence
  Description of Artificial Sequence: Synthetic peptide
  XENP019467 vlCDR3
QQYGSSPWT

SEQ ID NO: 9485 - protein, 221 aa, Artificial Sequence; identical to SEQ ID NO: 7595
  Description of Artificial Sequence: Synthetic polypeptide
  XENP019468 [CTLA-4]_H0_L0.53_Fab Heavy Chain

SEQ ID NO: 9486 - protein, 118 aa, Artificial Sequence; identical to SEQ ID NO: 3737
  Description of Artificial Sequence: Synthetic polypeptide
  VH of XENP019468

SEQ ID NO: 9487 - protein, 5 aa, Artificial Sequence
  Description of Artificial Sequence: Synthetic peptide
  XENP019468 vhCDR1
SYTMH

SEQ ID NO: 9488 - protein, 17 aa, Artificial Sequence
  Description of Artificial Sequence: Synthetic peptide
  XENP019468 vhCDR2
FISYDGNNKYYADSVKG

SEQ ID NO: 9489 - protein, 9 aa, Artificial Sequence
  Description of Artificial Sequence: Synthetic peptide
  XENP019468 vhCDR3
TGWLGPFDY

SEQ ID NO: 9490 - protein, 215 aa, Artificial Sequence
  Description of Artificial Sequence: Synthetic polypeptide
  XENP019468 [CTLA-4]_H0_L0.53_Fab Light Chain
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9491 - protein, 108 aa, Artificial Sequence; identical to SEQ ID NO: 4753
  Description of Artificial Sequence: Synthetic polypeptide
  VL of XENP019468

SEQ ID NO: 9492 - protein, 12 aa, Artificial Sequence
  Description of Artificial Sequence: Synthetic peptide
  XENP019468 vlCDR1
RASQSVGSSYLA

SEQ ID NO: 9493 - protein, 7 aa, Artificial Sequence
  Description of Artificial Sequence: Synthetic peptide
  XENP019468 vlCDR2
GAFSRAT

SEQ ID NO: 9494 - protein, 9 aa, Artificial Sequence
  Description of Artificial Sequence: Synthetic peptide
  XENP019468 vlCDR3
QQYGSSPWT

SEQ ID NO: 9495 - protein, 221 aa, Artificial Sequence; identical to SEQ ID NO: 7595
  Description of Artificial Sequence: Synthetic polypeptide
  XENP019469 [CTLA-4]_H0_L0.54_Fab Heavy Chain

SEQ ID NO: 9496 - protein, 118 aa, Artificial Sequence; identical to SEQ ID NO: 3737
  Description of Artificial Sequence: Synthetic polypeptide
  VH of XENP019469

SEQ ID NO: 9497 - protein, 5 aa, Artificial Sequence
  Description of Artificial Sequence: Synthetic peptide
  XENP019469 vhCDR1
SYTMH

SEQ ID NO: 9498 - protein, 17 aa, Artificial Sequence
  Description of Artificial Sequence: Synthetic peptide
  XENP019469 vhCDR2
FISYDGNNKYYADSVKG

SEQ ID NO: 9499 - protein, 9 aa, Artificial Sequence
  Description of Artificial Sequence: Synthetic peptide
  XENP019469 vhCDR3
TGWLGPFDY

SEQ ID NO: 9500 - protein, 215 aa, Artificial Sequence
  Description of Artificial Sequence: Synthetic polypeptide
  XENP019469 [CTLA-4]_H0_L0.54_Fab Light Chain
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9501 - protein, 108 aa, Artificial Sequence; identical to SEQ ID NO: 6571
  Description of Artificial Sequence: Synthetic polypeptide
  VL of XENP019469

SEQ ID NO: 9502 - protein, 12 aa, Artificial Sequence
  Description of Artificial Sequence: Synthetic peptide
  XENP019469 vlCDR1
RASQSVGSSYLA

SEQ ID NO: 9503 - protein, 7 aa, Artificial Sequence
  Description of Artificial Sequence: Synthetic peptide
  XENP019469 vlCDR2
GAFSRAT

SEQ ID NO: 9504 - protein, 9 aa, Artificial Sequence
  Description of Artificial Sequence: Synthetic peptide
  XENP019469 vlCDR3
QQYGSSPWT

SEQ ID NO: 9505 - protein, 221 aa, Artificial Sequence; identical to SEQ ID NO: 7595
  Description of Artificial Sequence: Synthetic polypeptide
  XENP019470 [CTLA-4]_H0_L0.55_Fab Heavy Chain

SEQ ID NO: 9506 - protein, 118 aa, Artificial Sequence; identical to SEQ ID NO: 3737
  Description of Artificial Sequence: Synthetic polypeptide
  VH of XENP019470

SEQ ID NO: 9507 - protein, 5 aa, Artificial Sequence
  Description of Artificial Sequence: Synthetic peptide
  XENP019470 vhCDR1
SYTMH

SEQ ID NO: 9508 - protein, 17 aa, Artificial Sequence
  Description of Artificial Sequence: Synthetic peptide
  XENP019470 vhCDR2
FISYDGNNKYYADSVKG

SEQ ID NO: 9509 - protein, 9 aa, Artificial Sequence
  Description of Artificial Sequence: Synthetic peptide
  XENP019470 vhCDR3
TGWLGPFDY

SEQ ID NO: 9510 - protein, 215 aa, Artificial Sequence
  Description of Artificial Sequence: Synthetic polypeptide
  XENP019470 [CTLA-4]_H0_L0.55_Fab Light Chain
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9511 - protein, 108 aa, Artificial Sequence; identical to SEQ ID NO: 6580
  Description of Artificial Sequence: Synthetic polypeptide
  VL of XENP019470

SEQ ID NO: 9512 - protein, 12 aa, Artificial Sequence
  Description of Artificial Sequence: Synthetic peptide
  XENP019470 vlCDR1
RASQSVGSSYLA

SEQ ID NO: 9513 - protein, 7 aa, Artificial Sequence
  Description of Artificial Sequence: Synthetic peptide
  XENP019470 vlCDR2
GAFSRAT

SEQ ID NO: 9514 - protein, 9 aa, Artificial Sequence
  Description of Artificial Sequence: Synthetic peptide
  XENP019470 vlCDR3
QQYGSSPWT

SEQ ID NO: 9515 - protein, 221 aa, Artificial Sequence; identical to SEQ ID NO: 7595
  Description of Artificial Sequence: Synthetic polypeptide
  XENP019471 [CTLA-4]_H0_L0.56_Fab Heavy Chain

SEQ ID NO: 9516 - protein, 118 aa, Artificial Sequence; identical to SEQ ID NO: 3737
  Description of Artificial Sequence: Synthetic polypeptide
  VH of XENP019471

SEQ ID NO: 9517 - protein, 5 aa, Artificial Sequence
  Description of Artificial Sequence: Synthetic peptide
  XENP019471 vhCDR1
SYTMH

SEQ ID NO: 9518 - protein, 17 aa, Artificial Sequence
  Description of Artificial Sequence: Synthetic peptide
  XENP019471 vhCDR2
FISYDGNNKYYADSVKG

SEQ ID NO: 9519 - protein, 9 aa, Artificial Sequence
  Description of Artificial Sequence: Synthetic peptide
  XENP019471 vhCDR3
TGWLGPFDY

SEQ ID NO: 9520 - protein, 215 aa, Artificial Sequence
  Description of Artificial Sequence: Synthetic polypeptide
  XENP019471 [CTLA-4]_H0_L0.56_Fab Light Chain
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9521 - protein, 108 aa, Artificial Sequence; identical to SEQ ID NO: 6589
  Description of Artificial Sequence: Synthetic polypeptide
  VL of XENP019471

SEQ ID NO: 9522 - protein, 12 aa, Artificial Sequence
  Description of Artificial Sequence: Synthetic peptide
  XENP019471 vlCDR1
RASQSVGSSYLA

SEQ ID NO: 9523 - protein, 7 aa, Artificial Sequence
  Description of Artificial Sequence: Synthetic peptide
  XENP019471 vlCDR2
GAFSRAT

SEQ ID NO: 9524 - protein, 9 aa, Artificial Sequence
  Description of Artificial Sequence: Synthetic peptide
  XENP019471 vlCDR3
QQYGSSPWT

SEQ ID NO: 9525 - protein, 221 aa, Artificial Sequence; identical to SEQ ID NO: 7595
  Description of Artificial Sequence: Synthetic polypeptide
  XENP019472 [CTLA-4]_H0_L0.57_Fab Heavy Chain

SEQ ID NO: 9526 - protein, 118 aa, Artificial Sequence; identical to SEQ ID NO: 3737
  Description of Artificial Sequence: Synthetic polypeptide
  VH of XENP019472

SEQ ID NO: 9527 - protein, 5 aa, Artificial Sequence
  Description of Artificial Sequence: Synthetic peptide
  XENP019472 vhCDR1
SYTMH

SEQ ID NO: 9528 - protein, 17 aa, Artificial Sequence
  Description of Artificial Sequence: Synthetic peptide
  XENP019472 vhCDR2
FISYDGNNKYYADSVKG

SEQ ID NO: 9529 - protein, 9 aa, Artificial Sequence
  Description of Artificial Sequence: Synthetic peptide
  XENP019472 vhCDR3
TGWLGPFDY

SEQ ID NO: 9530 - protein, 215 aa, Artificial Sequence
  Description of Artificial Sequence: Synthetic polypeptide
  XENP019472 [CTLA-4]_H0_L0.57_Fab Light Chain
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9531 - protein, 108 aa, Artificial Sequence; identical to SEQ ID NO: 4762
  Description of Artificial Sequence: Synthetic polypeptide
  VL of XENP019472

SEQ ID NO: 9532 - protein, 12 aa, Artificial Sequence
  Description of Artificial Sequence: Synthetic peptide
  XENP019472 vlCDR1
RASQSVGSSYLA

SEQ ID NO: 9533 - protein, 7 aa, Artificial Sequence
  Description of Artificial Sequence: Synthetic peptide
  XENP019472 vlCDR2
GAFSRAT

SEQ ID NO: 9534 - protein, 9 aa, Artificial Sequence
  Description of Artificial Sequence: Synthetic peptide
  XENP019472 vlCDR3
QQYGSSPWT

SEQ ID NO: 9535 - protein, 221 aa, Artificial Sequence; identical to SEQ ID NO: 7595
  Description of Artificial Sequence: Synthetic polypeptide
  XENP019473 [CTLA-4]_H0_L0.58_Fab Heavy Chain

SEQ ID NO: 9536 - protein, 118 aa, Artificial Sequence; identical to SEQ ID NO: 3737
  Description of Artificial Sequence: Synthetic polypeptide
  VH of XENP019473

SEQ ID NO: 9537 - protein, 5 aa, Artificial Sequence
  Description of Artificial Sequence: Synthetic peptide
  XENP019473 vhCDR1
SYTMH

SEQ ID NO: 9538 - protein, 17 aa, Artificial Sequence
  Description of Artificial Sequence: Synthetic peptide
  XENP019473 vhCDR2
FISYDGNNKYYADSVKG

SEQ ID NO: 9539 - protein, 9 aa, Artificial Sequence
  Description of Artificial Sequence: Synthetic peptide
  XENP019473 vhCDR3
TGWLGPFDY

SEQ ID NO: 9540 - protein, 215 aa, Artificial Sequence
  Description of Artificial Sequence: Synthetic polypeptide
  XENP019473 [CTLA-4]_H0_L0.58_Fab Light Chain
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9541 - protein, 108 aa, Artificial Sequence; identical to SEQ ID NO: 6607
  Description of Artificial Sequence: Synthetic polypeptide
  VL of XENP019473

SEQ ID NO: 9542 - protein, 12 aa, Artificial Sequence
  Description of Artificial Sequence: Synthetic peptide
  XENP019473 vlCDR1
RASQSVGSSYLA

SEQ ID NO: 9543 - protein, 7 aa, Artificial Sequence
  Description of Artificial Sequence: Synthetic peptide
  XENP019473 vlCDR2
GAFSRAT

SEQ ID NO: 9544 - protein, 9 aa, Artificial Sequence
  Description of Artificial Sequence: Synthetic peptide
  XENP019473 vlCDR3
QQYGSSPWT

SEQ ID NO: 9545 - protein, 221 aa, Artificial Sequence; identical to SEQ ID NO: 7595
  Description of Artificial Sequence: Synthetic polypeptide
  XENP019474 [CTLA-4]_H0_L0.59_Fab Heavy Chain

SEQ ID NO: 9546 - protein, 118 aa, Artificial Sequence; identical to SEQ ID NO: 3737
  Description of Artificial Sequence: Synthetic polypeptide
  VH of XENP019474

SEQ ID NO: 9547 - protein, 5 aa, Artificial Sequence
  Description of Artificial Sequence: Synthetic peptide
  XENP019474 vhCDR1
SYTMH

SEQ ID NO: 9548 - protein, 17 aa, Artificial Sequence
  Description of Artificial Sequence: Synthetic peptide
  XENP019474 vhCDR2
FISYDGNNKYYADSVKG

SEQ ID NO: 9549 - protein, 9 aa, Artificial Sequence
  Description of Artificial Sequence: Synthetic peptide
  XENP019474 vhCDR3
TGWLGPFDY

SEQ ID NO: 9550 - protein, 215 aa, Artificial Sequence
  Description of Artificial Sequence: Synthetic polypeptide
  XENP019474 [CTLA-4]_H0_L0.59_Fab Light Chain
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9551 - protein, 108 aa, Artificial Sequence; identical to SEQ ID NO: 6616
  Description of Artificial Sequence: Synthetic polypeptide
  VL of XENP019474

SEQ ID NO: 9552 - protein, 12 aa, Artificial Sequence
  Description of Artificial Sequence: Synthetic peptide
  XENP019474 vlCDR1
RASQSVGSSYLA

SEQ ID NO: 9553 - protein, 7 aa, Artificial Sequence
  Description of Artificial Sequence: Synthetic peptide
  XENP019474 vlCDR2
GAFSRAT

SEQ ID NO: 9554 - protein, 9 aa, Artificial Sequence
  Description of Artificial Sequence: Synthetic peptide
  XENP019474 vlCDR3
QQYGSSPWT

SEQ ID NO: 9555 - protein, 221 aa, Artificial Sequence; identical to SEQ ID NO: 7595
  Description of Artificial Sequence: Synthetic polypeptide
  XENP019475 [CTLA-4]_H0_L0.60_Fab Heavy Chain

SEQ ID NO: 9556 - protein, 118 aa, Artificial Sequence; identical to SEQ ID NO: 3737
  Description of Artificial Sequence: Synthetic polypeptide
  VH of XENP019475

SEQ ID NO: 9557 - protein, 5 aa, Artificial Sequence
  Description of Artificial Sequence: Synthetic peptide
  XENP019475 vhCDR1
SYTMH

SEQ ID NO: 9558 - protein, 17 aa, Artificial Sequence
  Description of Artificial Sequence: Synthetic peptide
  XENP019475 vhCDR2
FISYDGNNKYYADSVKG

SEQ ID NO: 9559 - protein, 9 aa, Artificial Sequence
  Description of Artificial Sequence: Synthetic peptide
  XENP019475 vhCDR3
TGWLGPFDY

SEQ ID NO: 9560 - protein, 215 aa, Artificial Sequence
  Description of Artificial Sequence: Synthetic polypeptide
  XENP019475 [CTLA-4]_H0_L0.60_Fab Light Chain
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9561 - protein, 108 aa, Artificial Sequence; identical to SEQ ID NO: 6625
  Description of Artificial Sequence: Synthetic polypeptide
  VL of XENP019475

SEQ ID NO: 9562 - protein, 12 aa, Artificial Sequence
  Description of Artificial Sequence: Synthetic peptide
  XENP019475 vlCDR1
RASQSVGSSYLA

SEQ ID NO: 9563 - protein, 7 aa, Artificial Sequence
  Description of Artificial Sequence: Synthetic peptide
  XENP019475 vlCDR2
GAFSRAT

SEQ ID NO: 9564 - protein, 9 aa, Artificial Sequence
  Description of Artificial Sequence: Synthetic peptide
  XENP019475 vlCDR3
QQYGSSPWT

SEQ ID NO: 9565 - protein, 221 aa, Artificial Sequence; identical to SEQ ID NO: 7595
  Description of Artificial Sequence: Synthetic polypeptide
  XENP019476 [CTLA-4]_H0_L0.61_Fab Heavy Chain

SEQ ID NO: 9566 - protein, 118 aa, Artificial Sequence; identical to SEQ ID NO: 3737
  Description of Artificial Sequence: Synthetic polypeptide
  VH of XENP019476

SEQ ID NO: 9567 - protein, 5 aa, Artificial Sequence
  Description of Artificial Sequence: Synthetic peptide
  XENP019476 vhCDR1
SYTMH

SEQ ID NO: 9568 - protein, 17 aa, Artificial Sequence
  Description of Artificial Sequence: Synthetic peptide
  XENP019476 vhCDR2
FISYDGNNKYYADSVKG

SEQ ID NO: 9569 - protein, 9 aa, Artificial Sequence
  Description of Artificial Sequence: Synthetic peptide
  XENP019476 vhCDR3
TGWLGPFDY

SEQ ID NO: 9570 - protein, 215 aa, Artificial Sequence
  Description of Artificial Sequence: Synthetic polypeptide
  XENP019476 [CTLA-4]_H0_L0.61_Fab Light Chain
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9571 - protein, 108 aa, Artificial Sequence; identical to SEQ ID NO: 6634
  Description of Artificial Sequence: Synthetic polypeptide
  VL of XENP019476

SEQ ID NO: 9572 - protein, 12 aa, Artificial Sequence
  Description of Artificial Sequence: Synthetic peptide
  XENP019476 vlCDR1
RASQSVGSSYLA

SEQ ID NO: 9573 - protein, 7 aa, Artificial Sequence
  Description of Artificial Sequence: Synthetic peptide
  XENP019476 vlCDR2
GAFSRDT

SEQ ID NO: 9574 - protein, 9 aa, Artificial Sequence
  Description of Artificial Sequence: Synthetic peptide
  XENP019476 vlCDR3
QQYGSSPWT

SEQ ID NO: 9575 - protein, 221 aa, Artificial Sequence; identical to SEQ ID NO: 7595
  Description of Artificial Sequence: Synthetic polypeptide
  XENP019477 [CTLA-4]_H0_L0.62_Fab Heavy Chain

SEQ ID NO: 9576 - protein, 118 aa, Artificial Sequence; identical to SEQ ID NO: 3737
  Description of Artificial Sequence: Synthetic polypeptide
  VH of XENP019477

SEQ ID NO: 9577 - protein, 5 aa, Artificial Sequence
  Description of Artificial Sequence: Synthetic peptide
  XENP019477 vhCDR1
SYTMH

SEQ ID NO: 9578 - protein, 17 aa, Artificial Sequence
  Description of Artificial Sequence: Synthetic peptide
  XENP019477 vhCDR2
FISYDGNNKYYADSVKG

SEQ ID NO: 9579 - protein, 9 aa, Artificial Sequence
  Description of Artificial Sequence: Synthetic peptide
  XENP019477 vhCDR3
TGWLGPFDY

SEQ ID NO: 9580 - protein, 215 aa, Artificial Sequence
  Description of Artificial Sequence: Synthetic polypeptide
  XENP019477 [CTLA-4]_H0_L0.62_Fab Light Chain
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9581 - protein, 108 aa, Artificial Sequence; identical to SEQ ID NO: 6643
  Description of Artificial Sequence: Synthetic polypeptide
  VL of XENP019477

SEQ ID NO: 9582 - protein, 12 aa, Artificial Sequence
  Description of Artificial Sequence: Synthetic peptide
  XENP019477 vlCDR1
RASQSVGSSYLA

SEQ ID NO: 9583 - protein, 7 aa, Artificial Sequence
  Description of Artificial Sequence: Synthetic peptide
  XENP019477 vlCDR2
GAFSRAT

SEQ ID NO: 9584 - protein, 9 aa, Artificial Sequence
  Description of Artificial Sequence: Synthetic peptide
  XENP019477 vlCDR3
QQYGSSPWT

SEQ ID NO: 9585 - protein, 221 aa, Artificial Sequence; identical to SEQ ID NO: 7595
  Description of Artificial Sequence: Synthetic polypeptide
  XENP019478 [CTLA-4]_H0_L0.63_Fab Heavy Chain

SEQ ID NO: 9586 - protein, 118 aa, Artificial Sequence; identical to SEQ ID NO: 3737
  Description of Artificial Sequence: Synthetic polypeptide
  VH of XENP019478

SEQ ID NO: 9587 - protein, 5 aa, Artificial Sequence
  Description of Artificial Sequence: Synthetic peptide
  XENP019478 vhCDR1
SYTMH

SEQ ID NO: 9588 - protein, 17 aa, Artificial Sequence
  Description of Artificial Sequence: Synthetic peptide
  XENP019478 vhCDR2
FISYDGNNKYYADSVKG

SEQ ID NO: 9589 - protein, 9 aa, Artificial Sequence
  Description of Artificial Sequence: Synthetic peptide
  XENP019478 vhCDR3
TGWLGPFDY

SEQ ID NO: 9590 - protein, 215 aa, Artificial Sequence
  Description of Artificial Sequence: Synthetic polypeptide
  XENP019478 [CTLA-4]_H0_L0.63_Fab Light Chain
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9591 - protein, 108 aa, Artificial Sequence; identical to SEQ ID NO: 6652
  Description of Artificial Sequence: Synthetic polypeptide
  VL of XENP019478

SEQ ID NO: 9592 - protein, 12 aa, Artificial Sequence
  Description of Artificial Sequence: Synthetic peptide
  XENP019478 vlCDR1
RASQSVGSSYLA

SEQ ID NO: 9593 - protein, 7 aa, Artificial Sequence
  Description of Artificial Sequence: Synthetic peptide
  XENP019478 vlCDR2
GAFSRAT

SEQ ID NO: 9594 - protein, 9 aa, Artificial Sequence
  Description of Artificial Sequence: Synthetic peptide
  XENP019478 vlCDR3
QQYGSSPWT

SEQ ID NO: 9595 - protein, 221 aa, Artificial Sequence; identical to SEQ ID NO: 7595
  Description of Artificial Sequence: Synthetic polypeptide
  XENP019479 [CTLA-4]_H0_L0.64_Fab Heavy Chain

SEQ ID NO: 9596 - protein, 118 aa, Artificial Sequence; identical to SEQ ID NO: 3737
  Description of Artificial Sequence: Synthetic polypeptide
  VH of XENP019479

SEQ ID NO: 9597 - protein, 5 aa, Artificial Sequence
  Description of Artificial Sequence: Synthetic peptide
  XENP019479 vhCDR1
SYTMH

SEQ ID NO: 9598 - protein, 17 aa, Artificial Sequence
  Description of Artificial Sequence: Synthetic peptide
  XENP019479 vhCDR2
FISYDGNNKYYADSVKG

SEQ ID NO: 9599 - protein, 9 aa, Artificial Sequence
  Description of Artificial Sequence: Synthetic peptide
  XENP019479 vhCDR3
TGWLGPFDY

SEQ ID NO: 9600 - protein, 215 aa, Artificial Sequence
  Description of Artificial Sequence: Synthetic polypeptide
  XENP019479 [CTLA-4]_H0_L0.64_Fab Light Chain
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9601 - protein, 108 aa, Artificial Sequence; identical to SEQ ID NO: 6661
  Description of Artificial Sequence: Synthetic polypeptide
  VL of XENP019479

SEQ ID NO: 9602 - protein, 12 aa, Artificial Sequence
  Description of Artificial Sequence: Synthetic peptide
  XENP019479 vlCDR1
RASQSVGSSYLA

SEQ ID NO: 9603 - protein, 7 aa, Artificial Sequence
  Description of Artificial Sequence: Synthetic peptide
  XENP019479 vlCDR2
GAFSRAT

SEQ ID NO: 9604 - protein, 9 aa, Artificial Sequence
  Description of Artificial Sequence: Synthetic peptide
  XENP019479 vlCDR3
QQYGSSPWT

SEQ ID NO: 9605 - protein, 221 aa, Artificial Sequence; identical to SEQ ID NO: 7595
  Description of Artificial Sequence: Synthetic polypeptide
  XENP019480 [CTLA-4]_H0_L0.65_Fab Heavy Chain

SEQ ID NO: 9606 - protein, 118 aa, Artificial Sequence; identical to SEQ ID NO: 3737
  Description of Artificial Sequence: Synthetic polypeptide
  VH of XENP019480

SEQ ID NO: 9607 - protein, 5 aa, Artificial Sequence
  Description of Artificial Sequence: Synthetic peptide
  XENP019480 vhCDR1
SYTMH

SEQ ID NO: 9608 - protein, 17 aa, Artificial Sequence
  Description of Artificial Sequence: Synthetic peptide
  XENP019480 vhCDR2
FISYDGNNKYYADSVKG

SEQ ID NO: 9609 - protein, 9 aa, Artificial Sequence
  Description of Artificial Sequence: Synthetic peptide
  XENP019480 vhCDR3
TGWLGPFDY

SEQ ID NO: 9610 - protein, 215 aa, Artificial Sequence
  Description of Artificial Sequence: Synthetic polypeptide
  XENP019480 [CTLA-4]_H0_L0.65_Fab Light Chain
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9611 - protein, 108 aa, Artificial Sequence; identical to SEQ ID NO: 6670
  Description of Artificial Sequence: Synthetic polypeptide
  VL of XENP019480

SEQ ID NO: 9612 - protein, 12 aa, Artificial Sequence
  Description of Artificial Sequence: Synthetic peptide
  XENP019480 vlCDR1
RASQSVGSSYLA

SEQ ID NO: 9613 - protein, 7 aa, Artificial Sequence
  Description of Artificial Sequence: Synthetic peptide
  XENP019480 vlCDR2
GAFSRAT

SEQ ID NO: 9614 - protein, 9 aa, Artificial Sequence
  Description of Artificial Sequence: Synthetic peptide
  XENP019480 vlCDR3
QQYGSSPWT

SEQ ID NO: 9615 - protein, 221 aa, Artificial Sequence; identical to SEQ ID NO: 7595
  Description of Artificial Sequence: Synthetic polypeptide
  XENP019481 [CTLA-4]_H0_L0.66_Fab Heavy Chain

SEQ ID NO: 9616 - protein, 118 aa, Artificial Sequence; identical to SEQ ID NO: 3737
  Description of Artificial Sequence: Synthetic polypeptide
  VH of XENP019481

SEQ ID NO: 9617 - protein, 5 aa, Artificial Sequence
  Description of Artificial Sequence: Synthetic peptide
  XENP019481 vhCDR1
SYTMH

SEQ ID NO: 9618 - protein, 17 aa, Artificial Sequence
  Description of Artificial Sequence: Synthetic peptide
  XENP019481 vhCDR2
FISYDGNNKYYADSVKG

SEQ ID NO: 9619 - protein, 9 aa, Artificial Sequence
  Description of Artificial Sequence: Synthetic peptide
  XENP019481 vhCDR3
TGWLGPFDY

SEQ ID NO: 9620 - protein, 215 aa, Artificial Sequence
  Description of Artificial Sequence: Synthetic polypeptide
  XENP019481 [CTLA-4]_H0_L0.66_Fab Light Chain
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9621 - protein, 108 aa, Artificial Sequence; identical to SEQ ID NO: 6679
  Description of Artificial Sequence: Synthetic polypeptide
  VL of XENP019481

SEQ ID NO: 9622 - protein, 12 aa, Artificial Sequence
  Description of Artificial Sequence: Synthetic peptide
  XENP019481 vlCDR1
RASQSVGSSYLA

SEQ ID NO: 9623 - protein, 7 aa, Artificial Sequence
  Description of Artificial Sequence: Synthetic peptide
  XENP019481 vlCDR2
GAFSRAT

SEQ ID NO: 9624 - protein, 9 aa, Artificial Sequence
  Description of Artificial Sequence: Synthetic peptide
  XENP019481 vlCDR3
QQYGSSPWT

SEQ ID NO: 9625 - protein, 221 aa, Artificial Sequence; identical to SEQ ID NO: 7595
  Description of Artificial Sequence: Synthetic polypeptide
  XENP019482 [CTLA-4]_H0_L0.67_Fab Heavy Chain

SEQ ID NO: 9626 - protein, 118 aa, Artificial Sequence; identical to SEQ ID NO: 3737
  Description of Artificial Sequence: Synthetic polypeptide
  VH of XENP019482

SEQ ID NO: 9627 - protein, 5 aa, Artificial Sequence
  Description of Artificial Sequence: Synthetic peptide
  XENP019482 vhCDR1
SYTMH

SEQ ID NO: 9628 - protein, 17 aa, Artificial Sequence
  Description of Artificial Sequence: Synthetic peptide
  XENP019482 vhCDR2
FISYDGNNKYYADSVKG

SEQ ID NO: 9629 - protein, 9 aa, Artificial Sequence
  Description of Artificial Sequence: Synthetic peptide
  XENP019482 vhCDR3
TGWLGPFDY

SEQ ID NO: 9630 - protein, 215 aa, Artificial Sequence
  Description of Artificial Sequence: Synthetic polypeptide
  XENP019482 [CTLA-4]_H0_L0.67_Fab Light Chain
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9631 - protein, 108 aa, Artificial Sequence; identical to SEQ ID NO: 6688
  Description of Artificial Sequence: Synthetic polypeptide
  VL of XENP019482

SEQ ID NO: 9632 - protein, 12 aa, Artificial Sequence
  Description of Artificial Sequence: Synthetic peptide
  XENP019482 vlCDR1
RASQSVGSSYLA

SEQ ID NO: 9633 - protein, 7 aa, Artificial Sequence
  Description of Artificial Sequence: Synthetic peptide
  XENP019482 vlCDR2
DAFSRAT

SEQ ID NO: 9634 - protein, 9 aa, Artificial Sequence
  Description of Artificial Sequence: Synthetic peptide
  XENP019482 vlCDR3
QQYGSSPWT

SEQ ID NO: 9635 - protein, 221 aa, Artificial Sequence; identical to SEQ ID NO: 7595
  Description of Artificial Sequence: Synthetic polypeptide
  XENP019483 [CTLA-4]_H0_L0.68_Fab Heavy Chain

SEQ ID NO: 9636 - protein, 118 aa, Artificial Sequence; identical to SEQ ID NO: 3737
  Description of Artificial Sequence: Synthetic polypeptide
  VH of XENP019483

SEQ ID NO: 9637 - protein, 5 aa, Artificial Sequence
  Description of Artificial Sequence: Synthetic peptide
  XENP019483 vhCDR1
SYTMH

SEQ ID NO: 9638 - protein, 17 aa, Artificial Sequence
  Description of Artificial Sequence: Synthetic peptide
  XENP019483 vhCDR2
FISYDGNNKYYADSVKG

SEQ ID NO: 9639 - protein, 9 aa, Artificial Sequence
  Description of Artificial Sequence: Synthetic peptide
  XENP019483 vhCDR3
TGWLGPFDY

SEQ ID NO: 9640 - protein, 215 aa, Artificial Sequence
  Description of Artificial Sequence: Synthetic polypeptide
  XENP019483 [CTLA-4]_H0_L0.68_Fab Light Chain
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9641 - protein, 108 aa, Artificial Sequence; identical to SEQ ID NO: 6697
  Description of Artificial Sequence: Synthetic polypeptide
  VL of XENP019483

SEQ ID NO: 9642 - protein, 12 aa, Artificial Sequence
  Description of Artificial Sequence: Synthetic peptide
  XENP019483 vlCDR1
RASQSVGSSYLA

SEQ ID NO: 9643 - protein, 7 aa, Artificial Sequence
  Description of Artificial Sequence: Synthetic peptide
  XENP019483 vlCDR2
SAFSRAT

SEQ ID NO: 9644 - protein, 9 aa, Artificial Sequence
  Description of Artificial Sequence: Synthetic peptide
  XENP019483 vlCDR3
QQYGSSPWT

SEQ ID NO: 9645 - protein, 221 aa, Artificial Sequence; identical to SEQ ID NO: 7595
  Description of Artificial Sequence: Synthetic polypeptide
  XENP019484 [CTLA-4]_H0_L0.69_Fab Heavy Chain

SEQ ID NO: 9646 - protein, 118 aa, Artificial Sequence; identical to SEQ ID NO: 3737
  Description of Artificial Sequence: Synthetic polypeptide
  VH of XENP019484

SEQ ID NO: 9647 - protein, 5 aa, Artificial Sequence
  Description of Artificial Sequence: Synthetic peptide
  XENP019484 vhCDR1
SYTMH

SEQ ID NO: 9648 - protein, 17 aa, Artificial Sequence
  Description of Artificial Sequence: Synthetic peptide
  XENP019484 vhCDR2
FISYDGNNKYYADSVKG

SEQ ID NO: 9649 - protein, 9 aa, Artificial Sequence
  Description of Artificial Sequence: Synthetic peptide
  XENP019484 vhCDR3
TGWLGPFDY

SEQ ID NO: 9650 - protein, 215 aa, Artificial Sequence
  Description of Artificial Sequence: Synthetic polypeptide
  XENP019484 [CTLA-4]_H0_L0.69_Fab Light Chain
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9651 - protein, 108 aa, Artificial Sequence; identical to SEQ ID NO: 6706
  Description of Artificial Sequence: Synthetic polypeptide
  VL of XENP019484

SEQ ID NO: 9652 - protein, 12 aa, Artificial Sequence
  Description of Artificial Sequence: Synthetic peptide
  XENP019484 vlCDR1
RASQSVGSSYLA

SEQ ID NO: 9653 - protein, 7 aa, Artificial Sequence
  Description of Artificial Sequence: Synthetic peptide
  XENP019484 vlCDR2
GVFSRAT

SEQ ID NO: 9654 - protein, 9 aa, Artificial Sequence
  Description of Artificial Sequence: Synthetic peptide
  XENP019484 vlCDR3
QQYGSSPWT

SEQ ID NO: 9655 - protein, 221 aa, Artificial Sequence; identical to SEQ ID NO: 7595
  Description of Artificial Sequence: Synthetic polypeptide
  XENP019485 [CTLA-4]_H0_L0.70_Fab Heavy Chain

SEQ ID NO: 9656 - protein, 118 aa, Artificial Sequence; identical to SEQ ID NO: 3737
  Description of Artificial Sequence: Synthetic polypeptide
  VH of XENP019485

SEQ ID NO: 9657 - protein, 5 aa, Artificial Sequence
  Description of Artificial Sequence: Synthetic peptide
  XENP019485 vhCDR1
SYTMH

SEQ ID NO: 9658 - protein, 17 aa, Artificial Sequence
  Description of Artificial Sequence: Synthetic peptide
  XENP019485 vhCDR2
FISYDGNNKYYADSVKG

SEQ ID NO: 9659 - protein, 9 aa, Artificial Sequence
  Description of Artificial Sequence: Synthetic peptide
  XENP019485 vhCDR3
TGWLGPFDY

SEQ ID NO: 9660 - protein, 215 aa, Artificial Sequence
  Description of Artificial Sequence: Synthetic polypeptide
  XENP019485 [CTLA-4]_H0_L0.70_Fab Light Chain
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9661 - protein, 108 aa, Artificial Sequence; identical to SEQ ID NO: 6715
  Description of Artificial Sequence: Synthetic polypeptide
  VL of XENP019485

SEQ ID NO: 9662 - protein, 12 aa, Artificial Sequence
  Description of Artificial Sequence: Synthetic peptide
  XENP019485 vlCDR1
RASQSVGSSYLA

SEQ ID NO: 9663 - protein, 7 aa, Artificial Sequence
  Description of Artificial Sequence: Synthetic peptide
  XENP019485 vlCDR2
GAHSRAT

SEQ ID NO: 9664 - protein, 9 aa, Artificial Sequence
  Description of Artificial Sequence: Synthetic peptide
  XENP019485 vlCDR3
QQYGSSPWT

SEQ ID NO: 9665 - protein, 221 aa, Artificial Sequence; identical to SEQ ID NO: 7595
  Description of Artificial Sequence: Synthetic polypeptide
  XENP019486 [CTLA-4]_H0_L0.71_Fab Heavy Chain

SEQ ID NO: 9666 - protein, 118 aa, Artificial Sequence; identical to SEQ ID NO: 3737
  Description of Artificial Sequence: Synthetic polypeptide
  VH of XENP019486

SEQ ID NO: 9667 - protein, 5 aa, Artificial Sequence
  Description of Artificial Sequence: Synthetic peptide
  XENP019486 vhCDR1
SYTMH

SEQ ID NO: 9668 - protein, 17 aa, Artificial Sequence
  Description of Artificial Sequence: Synthetic peptide
  XENP019486 vhCDR2
FISYDGNNKYYADSVKG

SEQ ID NO: 9669 - protein, 9 aa, Artificial Sequence
  Description of Artificial Sequence: Synthetic peptide
  XENP019486 vhCDR3
TGWLGPFDY

SEQ ID NO: 9670 - protein, 215 aa, Artificial Sequence
  Description of Artificial Sequence: Synthetic polypeptide
  XENP019486 [CTLA-4]_H0_L0.71_Fab Light Chain
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9671 - protein, 108 aa, Artificial Sequence; identical to SEQ ID NO: 6724
  Description of Artificial Sequence: Synthetic polypeptide
  VL of XENP019486

SEQ ID NO: 9672 - protein, 12 aa, Artificial Sequence
  Description of Artificial Sequence: Synthetic peptide
  XENP019486 vlCDR1
RASQSVGSSYLA

SEQ ID NO: 9673 - protein, 7 aa, Artificial Sequence
  Description of Artificial Sequence: Synthetic peptide
  XENP019486 vlCDR2
GAISRAT

SEQ ID NO: 9674 - protein, 9 aa, Artificial Sequence
  Description of Artificial Sequence: Synthetic peptide
  XENP019486 vlCDR3
QQYGSSPWT

SEQ ID NO: 9675 - protein, 221 aa, Artificial Sequence; identical to SEQ ID NO: 7595
  Description of Artificial Sequence: Synthetic polypeptide
  XENP019487 [CTLA-4]_H0_L0.72_Fab Heavy Chain

SEQ ID NO: 9676 - protein, 118 aa, Artificial Sequence; identical to SEQ ID NO: 3737
  Description of Artificial Sequence: Synthetic polypeptide
  VH of XENP019487

SEQ ID NO: 9677 - protein, 5 aa, Artificial Sequence
  Description of Artificial Sequence: Synthetic peptide
  XENP019487 vhCDR1
SYTMH

SEQ ID NO: 9678 - protein, 17 aa, Artificial Sequence
  Description of Artificial Sequence: Synthetic peptide
  XENP019487 vhCDR2
FISYDGNNKYYADSVKG

SEQ ID NO: 9679 - protein, 9 aa, Artificial Sequence
  Description of Artificial Sequence: Synthetic peptide
  XENP019487 vhCDR3
TGWLGPFDY

SEQ ID NO: 9680 - protein, 215 aa, Artificial Sequence
  Description of Artificial Sequence: Synthetic polypeptide
  XENP019487 [CTLA-4]_H0_L0.72_Fab Light Chain
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9681 - protein, 108 aa, Artificial Sequence; identical to SEQ ID NO: 6733
  Description of Artificial Sequence: Synthetic polypeptide
  VL of XENP019487

SEQ ID NO: 9682 - protein, 12 aa, Artificial Sequence
  Description of Artificial Sequence: Synthetic peptide
  XENP019487 vlCDR1
RASQSVGSSYLA

SEQ ID NO: 9683 - protein, 7 aa, Artificial Sequence
  Description of Artificial Sequence: Synthetic peptide
  XENP019487 vlCDR2
GALSRAT

SEQ ID NO: 9684 - protein, 9 aa, Artificial Sequence
  Description of Artificial Sequence: Synthetic peptide
  XENP019487 vlCDR3
QQYGSSPWT

SEQ ID NO: 9685 - protein, 221 aa, Artificial Sequence; identical to SEQ ID NO: 7595
  Description of Artificial Sequence: Synthetic polypeptide
  XENP019488 [CTLA-4]_H0_L0.73_Fab Heavy Chain

SEQ ID NO: 9686 - protein, 118 aa, Artificial Sequence; identical to SEQ ID NO: 3737
  Description of Artificial Sequence: Synthetic polypeptide
  VH of XENP019488

SEQ ID NO: 9687 - protein, 5 aa, Artificial Sequence
  Description of Artificial Sequence: Synthetic peptide
  XENP019488 vhCDR1
SYTMH

SEQ ID NO: 9688 - protein, 17 aa, Artificial Sequence
  Description of Artificial Sequence: Synthetic peptide
  XENP019488 vhCDR2
FISYDGNNKYYADSVKG

SEQ ID NO: 9689 - protein, 9 aa, Artificial Sequence
  Description of Artificial Sequence: Synthetic peptide
  XENP019488 vhCDR3
TGWLGPFDY

SEQ ID NO: 9690 - protein, 215 aa, Artificial Sequence
  Description of Artificial Sequence: Synthetic polypeptide
  XENP019488 [CTLA-4]_H0_L0.73_Fab Light Chain
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9691 - protein, 108 aa, Artificial Sequence; identical to SEQ ID NO: 6742
  Description of Artificial Sequence: Synthetic polypeptide
  VL of XENP019488

SEQ ID NO: 9692 - protein, 12 aa, Artificial Sequence
  Description of Artificial Sequence: Synthetic peptide
  XENP019488 vlCDR1
RASQSVGSSYLA

SEQ ID NO: 9693 - protein, 7 aa, Artificial Sequence
  Description of Artificial Sequence: Synthetic peptide
  XENP019488 vlCDR2
GASSRAT

SEQ ID NO: 9694 - protein, 9 aa, Artificial Sequence
  Description of Artificial Sequence: Synthetic peptide
  XENP019488 vlCDR3
QQYGSSPWT

SEQ ID NO: 9695 - protein, 221 aa, Artificial Sequence; identical to SEQ ID NO: 7595
  Description of Artificial Sequence: Synthetic polypeptide
  XENP019489 [CTLA-4]_H0_L0.74_Fab Heavy Chain

SEQ ID NO: 9696 - protein, 118 aa, Artificial Sequence; identical to SEQ ID NO: 3737
  Description of Artificial Sequence: Synthetic polypeptide
  VH of XENP019489

SEQ ID NO: 9697 - protein, 5 aa, Artificial Sequence
  Description of Artificial Sequence: Synthetic peptide
  XENP019489 vhCDR1
SYTMH

SEQ ID NO: 9698 - protein, 17 aa, Artificial Sequence
  Description of Artificial Sequence: Synthetic peptide
  XENP019489 vhCDR2
FISYDGNNKYYADSVKG

SEQ ID NO: 9699 - protein, 9 aa, Artificial Sequence
  Description of Artificial Sequence: Synthetic peptide
  XENP019489 vhCDR3
TGWLGPFDY

SEQ ID NO: 9700 - protein, 215 aa, Artificial Sequence
  Description of Artificial Sequence: Synthetic polypeptide
  XENP019489 [CTLA-4]_H0_L0.74_Fab Light Chain
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9701 - protein, 108 aa, Artificial Sequence; identical to SEQ ID NO: 6751
  Description of Artificial Sequence: Synthetic polypeptide
  VL of XENP019489

SEQ ID NO: 9702 - protein, 12 aa, Artificial Sequence
  Description of Artificial Sequence: Synthetic peptide
  XENP019489 vlCDR1
RASQSVGSSYLA

SEQ ID NO: 9703 - protein, 7 aa, Artificial Sequence
  Description of Artificial Sequence: Synthetic peptide
  XENP019489 vlCDR2
GAYSRAT

SEQ ID NO: 9704 - protein, 9 aa, Artificial Sequence
  Description of Artificial Sequence: Synthetic peptide
  XENP019489 vlCDR3
QQYGSSPWT

SEQ ID NO: 9705 - protein, 221 aa, Artificial Sequence; identical to SEQ ID NO: 7595
  Description of Artificial Sequence: Synthetic polypeptide
  XENP019490 [CTLA-4]_H0_L0.75_Fab Heavy Chain

SEQ ID NO: 9706 - protein, 118 aa, Artificial Sequence; identical to SEQ ID NO: 3737
  Description of Artificial Sequence: Synthetic polypeptide
  VH of XENP019490

SEQ ID NO: 9707 - protein, 5 aa, Artificial Sequence
  Description of Artificial Sequence: Synthetic peptide
  XENP019490 vhCDR1
SYTMH

SEQ ID NO: 9708 - protein, 17 aa, Artificial Sequence
  Description of Artificial Sequence: Synthetic peptide
  XENP019490 vhCDR2
FISYDGNNKYYADSVKG

SEQ ID NO: 9709 - protein, 9 aa, Artificial Sequence
  Description of Artificial Sequence: Synthetic peptide
  XENP019490 vhCDR3
TGWLGPFDY

SEQ ID NO: 9710 - protein, 215 aa, Artificial Sequence
  Description of Artificial Sequence: Synthetic polypeptide
  XENP019490 [CTLA-4]_H0_L0.75_Fab Light Chain
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9711 - protein, 108 aa, Artificial Sequence; identical to SEQ ID NO: 6760
  Description of Artificial Sequence: Synthetic polypeptide
  VL of XENP019490

SEQ ID NO: 9712 - protein, 12 aa, Artificial Sequence
  Description of Artificial Sequence: Synthetic peptide
  XENP019490 vlCDR1
RASQSVGSSYLA

SEQ ID NO: 9713 - protein, 7 aa, Artificial Sequence
  Description of Artificial Sequence: Synthetic peptide
  XENP019490 vlCDR2
GAFARAT

SEQ ID NO: 9714 - protein, 9 aa, Artificial Sequence
  Description of Artificial Sequence: Synthetic peptide
  XENP019490 vlCDR3
QQYGSSPWT

SEQ ID NO: 9715 - protein, 221 aa, Artificial Sequence; identical to SEQ ID NO: 7595
  Description of Artificial Sequence: Synthetic polypeptide
  XENP019491 [CTLA-4]_H0_L0.76_Fab Heavy Chain

SEQ ID NO: 9716 - protein, 118 aa, Artificial Sequence; identical to SEQ ID NO: 3737
  Description of Artificial Sequence: Synthetic polypeptide
  VH of XENP019491

SEQ ID NO: 9717 - protein, 5 aa, Artificial Sequence
  Description of Artificial Sequence: Synthetic peptide
  XENP019491 vhCDR1
SYTMH

SEQ ID NO: 9718 - protein, 17 aa, Artificial Sequence
  Description of Artificial Sequence: Synthetic peptide
  XENP019491 vhCDR2
FISYDGNNKYYADSVKG

SEQ ID NO: 9719 - protein, 9 aa, Artificial Sequence
  Description of Artificial Sequence: Synthetic peptide
  XENP019491 vhCDR3
TGWLGPFDY

SEQ ID NO: 9720 - protein, 215 aa, Artificial Sequence
  Description of Artificial Sequence: Synthetic polypeptide
  XENP019491 [CTLA-4]_H0_L0.76_Fab Light Chain
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9721 - protein, 108 aa, Artificial Sequence; identical to SEQ ID NO: 6769
  Description of Artificial Sequence: Synthetic polypeptide
  VL of XENP019491

SEQ ID NO: 9722 - protein, 12 aa, Artificial Sequence
  Description of Artificial Sequence: Synthetic peptide
  XENP019491 vlCDR1
RASQSVGSSYLA

SEQ ID NO: 9723 - protein, 7 aa, Artificial Sequence
  Description of Artificial Sequence: Synthetic peptide
  XENP019491 vlCDR2
GAFGRAT

SEQ ID NO: 9724 - protein, 9 aa, Artificial Sequence
  Description of Artificial Sequence: Synthetic peptide
  XENP019491 vlCDR3
QQYGSSPWT

SEQ ID NO: 9725 - protein, 221 aa, Artificial Sequence; identical to SEQ ID NO: 7595
  Description of Artificial Sequence: Synthetic polypeptide
  XENP019492 [CTLA-4]_H0_L0.77_Fab Heavy Chain

SEQ ID NO: 9726 - protein, 118 aa, Artificial Sequence; identical to SEQ ID NO: 3737
  Description of Artificial Sequence: Synthetic polypeptide
  VH of XENP019492

SEQ ID NO: 9727 - protein, 5 aa, Artificial Sequence
  Description of Artificial Sequence: Synthetic peptide
  XENP019492 vhCDR1
SYTMH

SEQ ID NO: 9728 - protein, 17 aa, Artificial Sequence
  Description of Artificial Sequence: Synthetic peptide
  XENP019492 vhCDR2
FISYDGNNKYYADSVKG

SEQ ID NO: 9729 - protein, 9 aa, Artificial Sequence
  Description of Artificial Sequence: Synthetic peptide
  XENP019492 vhCDR3
TGWLGPFDY

SEQ ID NO: 9730 - protein, 215 aa, Artificial Sequence
  Description of Artificial Sequence: Synthetic polypeptide
  XENP019492 [CTLA-4]_H0_L0.77_Fab Light Chain
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9731 - protein, 108 aa, Artificial Sequence; identical to SEQ ID NO: 6778
  Description of Artificial Sequence: Synthetic polypeptide
  VL of XENP019492

SEQ ID NO: 9732 - protein, 12 aa, Artificial Sequence
  Description of Artificial Sequence: Synthetic peptide
  XENP019492 vlCDR1
RASQSVGSSYLA

SEQ ID NO: 9733 - protein, 7 aa, Artificial Sequence
  Description of Artificial Sequence: Synthetic peptide
  XENP019492 vlCDR2
GAFNRAT

SEQ ID NO: 9734 - protein, 9 aa, Artificial Sequence
  Description of Artificial Sequence: Synthetic peptide
  XENP019492 vlCDR3
QQYGSSPWT

SEQ ID NO: 9735 - protein, 221 aa, Artificial Sequence; identical to SEQ ID NO: 7595
  Description of Artificial Sequence: Synthetic polypeptide
  XENP019493 [CTLA-4]_H0_L0.78_Fab Heavy Chain

SEQ ID NO: 9736 - protein, 118 aa, Artificial Sequence; identical to SEQ ID NO: 3737
  Description of Artificial Sequence: Synthetic polypeptide
  VH of XENP019493

SEQ ID NO: 9737 - protein, 5 aa, Artificial Sequence
  Description of Artificial Sequence: Synthetic peptide
  XENP019493 vhCDR1
SYTMH

SEQ ID NO: 9738 - protein, 17 aa, Artificial Sequence
  Description of Artificial Sequence: Synthetic peptide
  XENP019493 vhCDR2
FISYDGNNKYYADSVKG

SEQ ID NO: 9739 - protein, 9 aa, Artificial Sequence
  Description of Artificial Sequence: Synthetic peptide
  XENP019493 vhCDR3
TGWLGPFDY

SEQ ID NO: 9740 - protein, 215 aa, Artificial Sequence
  Description of Artificial Sequence: Synthetic polypeptide
  XENP019493 [CTLA-4]_H0_L0.78_Fab Light Chain
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9741 - protein, 108 aa, Artificial Sequence; identical to SEQ ID NO: 6787
  Description of Artificial Sequence: Synthetic polypeptide
  VL of XENP019493

SEQ ID NO: 9742 - protein, 12 aa, Artificial Sequence
  Description of Artificial Sequence: Synthetic peptide
  XENP019493 vlCDR1
RASQSVGSSYLA

SEQ ID NO: 9743 - protein, 7 aa, Artificial Sequence
  Description of Artificial Sequence: Synthetic peptide
  XENP019493 vlCDR2
GAFQRAT

SEQ ID NO: 9744 - protein, 9 aa, Artificial Sequence
  Description of Artificial Sequence: Synthetic peptide
  XENP019493 vlCDR3
QQYGSSPWT

SEQ ID NO: 9745 - protein, 221 aa, Artificial Sequence; identical to SEQ ID NO: 7595
  Description of Artificial Sequence: Synthetic polypeptide
  XENP019494 [CTLA-4]_H0_L0.79_Fab Heavy Chain

SEQ ID NO: 9746 - protein, 118 aa, Artificial Sequence; identical to SEQ ID NO: 3737
  Description of Artificial Sequence: Synthetic polypeptide
  VH of XENP019494

SEQ ID NO: 9747 - protein, 5 aa, Artificial Sequence
  Description of Artificial Sequence: Synthetic peptide
  XENP019494 vhCDR1
SYTMH

SEQ ID NO: 9748 - protein, 17 aa, Artificial Sequence
  Description of Artificial Sequence: Synthetic peptide
  XENP019494 vhCDR2
FISYDGNNKYYADSVKG

SEQ ID NO: 9749 - protein, 9 aa, Artificial Sequence
  Description of Artificial Sequence: Synthetic peptide
  XENP019494 vhCDR3
TGWLGPFDY

SEQ ID NO: 9750 - protein, 215 aa, Artificial Sequence
  Description of Artificial Sequence: Synthetic polypeptide
  XENP019494 [CTLA-4]_H0_L0.79_Fab Light Chain
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9751 - protein, 108 aa, Artificial Sequence; identical to SEQ ID NO: 6796
  Description of Artificial Sequence: Synthetic polypeptide
  VL of XENP019494

SEQ ID NO: 9752 - protein, 12 aa, Artificial Sequence
  Description of Artificial Sequence: Synthetic peptide
  XENP019494 vlCDR1
RASQSVGSSYLA

SEQ ID NO: 9753 - protein, 7 aa, Artificial Sequence
  Description of Artificial Sequence: Synthetic peptide
  XENP019494 vlCDR2
GAFTRAT

SEQ ID NO: 9754 - protein, 9 aa, Artificial Sequence
  Description of Artificial Sequence: Synthetic peptide
  XENP019494 vlCDR3
QQYGSSPWT

SEQ ID NO: 9755 - protein, 221 aa, Artificial Sequence; identical to SEQ ID NO: 7595
  Description of Artificial Sequence: Synthetic polypeptide
  XENP019495 [CTLA-4]_H0_L0.80_Fab Heavy Chain

SEQ ID NO: 9756 - protein, 118 aa, Artificial Sequence; identical to SEQ ID NO: 3737
  Description of Artificial Sequence: Synthetic polypeptide
  VH of XENP019495

SEQ ID NO: 9757 - protein, 5 aa, Artificial Sequence
  Description of Artificial Sequence: Synthetic peptide
  XENP019495 vhCDR1
SYTMH

SEQ ID NO: 9758 - protein, 17 aa, Artificial Sequence
  Description of Artificial Sequence: Synthetic peptide
  XENP019495 vhCDR2
FISYDGNNKYYADSVKG

SEQ ID NO: 9759 - protein, 9 aa, Artificial Sequence
  Description of Artificial Sequence: Synthetic peptide
  XENP019495 vhCDR3
TGWLGPFDY

SEQ ID NO: 9760 - protein, 215 aa, Artificial Sequence
  Description of Artificial Sequence: Synthetic polypeptide
  XENP019495 [CTLA-4]_H0_L0.80_Fab Light Chain
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9761 - protein, 108 aa, Artificial Sequence; identical to SEQ ID NO: 6805
  Description of Artificial Sequence: Synthetic polypeptide
  VL of XENP019495

SEQ ID NO: 9762 - protein, 12 aa, Artificial Sequence
  Description of Artificial Sequence: Synthetic peptide
  XENP019495 vlCDR1
RASQSVGSSYLA

SEQ ID NO: 9763 - protein, 7 aa, Artificial Sequence
  Description of Artificial Sequence: Synthetic peptide
  XENP019495 vlCDR2
GAFSRDT

SEQ ID NO: 9764 - protein, 9 aa, Artificial Sequence
  Description of Artificial Sequence: Synthetic peptide
  XENP019495 vlCDR3
QQYGSSPWT

SEQ ID NO: 9765 - protein, 221 aa, Artificial Sequence; identical to SEQ ID NO: 7595
  Description of Artificial Sequence: Synthetic polypeptide
  XENP019496 [CTLA-4]_H0_L0.81_Fab Heavy Chain

SEQ ID NO: 9766 - protein, 118 aa, Artificial Sequence; identical to SEQ ID NO: 3737
  Description of Artificial Sequence: Synthetic polypeptide
  VH of XENP019496

SEQ ID NO: 9767 - protein, 5 aa, Artificial Sequence
  Description of Artificial Sequence: Synthetic peptide
  XENP019496 vhCDR1
SYTMH

SEQ ID NO: 9768 - protein, 17 aa, Artificial Sequence
  Description of Artificial Sequence: Synthetic peptide
  XENP019496 vhCDR2
FISYDGNNKYYADSVKG

SEQ ID NO: 9769 - protein, 9 aa, Artificial Sequence
  Description of Artificial Sequence: Synthetic peptide
  XENP019496 vhCDR3
TGWLGPFDY

SEQ ID NO: 9770 - protein, 215 aa, Artificial Sequence
  Description of Artificial Sequence: Synthetic polypeptide
  XENP019496 [CTLA-4]_H0_L0.81_Fab Light Chain
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9771 - protein, 108 aa, Artificial Sequence; identical to SEQ ID NO: 6814
  Description of Artificial Sequence: Synthetic polypeptide
  VL of XENP019496

SEQ ID NO: 9772 - protein, 12 aa, Artificial Sequence
  Description of Artificial Sequence: Synthetic peptide
  XENP019496 vlCDR1
RASQSVGSSYLA

SEQ ID NO: 9773 - protein, 7 aa, Artificial Sequence
  Description of Artificial Sequence: Synthetic peptide
  XENP019496 vlCDR2
GAFSRAS

SEQ ID NO: 9774 - protein, 9 aa, Artificial Sequence
  Description of Artificial Sequence: Synthetic peptide
  XENP019496 vlCDR3
QQYGSSPWT

SEQ ID NO: 9775 - protein, 221 aa, Artificial Sequence; identical to SEQ ID NO: 7595
  Description of Artificial Sequence: Synthetic polypeptide
  XENP019501 [CTLA-4]_H0_L0.82_Fab Heavy Chain

SEQ ID NO: 9776 - protein, 118 aa, Artificial Sequence; identical to SEQ ID NO: 3737
  Description of Artificial Sequence: Synthetic polypeptide
  VH of XENP019501

SEQ ID NO: 9777 - protein, 5 aa, Artificial Sequence
  Description of Artificial Sequence: Synthetic peptide
  XENP019501 vhCDR1
SYTMH

SEQ ID NO: 9778 - protein, 17 aa, Artificial Sequence
  Description of Artificial Sequence: Synthetic peptide
  XENP019501 vhCDR2
FISYDGNNKYYADSVKG

SEQ ID NO: 9779 - protein, 9 aa, Artificial Sequence
  Description of Artificial Sequence: Synthetic peptide
  XENP019501 vhCDR3
TGWLGPFDY

SEQ ID NO: 9780 - protein, 215 aa, Artificial Sequence
  Description of Artificial Sequence: Synthetic polypeptide
  XENP019501 [CTLA-4]_H0_L0.82_Fab Light Chain
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9781 - protein, 108 aa, Artificial Sequence; identical to SEQ ID NO: 6823
  Description of Artificial Sequence: Synthetic polypeptide
  VL of XENP019501

SEQ ID NO: 9782 - protein, 12 aa, Artificial Sequence
  Description of Artificial Sequence: Synthetic peptide
  XENP019501 vlCDR1
RASQSVGSSYLA

SEQ ID NO: 9783 - protein, 7 aa, Artificial Sequence
  Description of Artificial Sequence: Synthetic peptide
  XENP019501 vlCDR2
GAFSRAT

SEQ ID NO: 9784 - protein, 9 aa, Artificial Sequence
  Description of Artificial Sequence: Synthetic peptide
  XENP019501 vlCDR3
QQYGSSPWT

SEQ ID NO: 9785 - protein, 221 aa, Artificial Sequence; identical to SEQ ID NO: 7595
  Description of Artificial Sequence: Synthetic polypeptide
  XENP019502 [CTLA-4]_H0_L0.83_Fab Heavy Chain

SEQ ID NO: 9786 - protein, 118 aa, Artificial Sequence; identical to SEQ ID NO: 3737
  Description of Artificial Sequence: Synthetic polypeptide
  VH of XENP019502

SEQ ID NO: 9787 - protein, 5 aa, Artificial Sequence
  Description of Artificial Sequence: Synthetic peptide
  XENP019502 vhCDR1
SYTMH

SEQ ID NO: 9788 - protein, 17 aa, Artificial Sequence
  Description of Artificial Sequence: Synthetic peptide
  XENP019502 vhCDR2
FISYDGNNKYYADSVKG

SEQ ID NO: 9789 - protein, 9 aa, Artificial Sequence
  Description of Artificial Sequence: Synthetic peptide
  XENP019502 vhCDR3
TGWLGPFDY

SEQ ID NO: 9790 - protein, 215 aa, Artificial Sequence
  Description of Artificial Sequence: Synthetic polypeptide
  XENP019502 [CTLA-4]_H0_L0.83_Fab Light Chain
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9791 - protein, 108 aa, Artificial Sequence; identical to SEQ ID NO: 6832
  Description of Artificial Sequence: Synthetic polypeptide
  VL of XENP019502

SEQ ID NO: 9792 - protein, 12 aa, Artificial Sequence
  Description of Artificial Sequence: Synthetic peptide
  XENP019502 vlCDR1
RASQSVGSSYLA

SEQ ID NO: 9793 - protein, 7 aa, Artificial Sequence
  Description of Artificial Sequence: Synthetic peptide
  XENP019502 vlCDR2
GAFSRAT

SEQ ID NO: 9794 - protein, 9 aa, Artificial Sequence
  Description of Artificial Sequence: Synthetic peptide
  XENP019502 vlCDR3
QQYGSSPWT

SEQ ID NO: 9795 - protein, 221 aa, Artificial Sequence; identical to SEQ ID NO: 7595
  Description of Artificial Sequence: Synthetic polypeptide
  XENP019503 [CTLA-4]_H0_L0.84_Fab Heavy Chain

SEQ ID NO: 9796 - protein, 118 aa, Artificial Sequence; identical to SEQ ID NO: 3737
  Description of Artificial Sequence: Synthetic polypeptide
  VH of XENP019503

SEQ ID NO: 9797 - protein, 5 aa, Artificial Sequence
  Description of Artificial Sequence: Synthetic peptide
  XENP019503 vhCDR1
SYTMH

SEQ ID NO: 9798 - protein, 17 aa, Artificial Sequence
  Description of Artificial Sequence: Synthetic peptide
  XENP019503 vhCDR2
FISYDGNNKYYADSVKG

SEQ ID NO: 9799 - protein, 9 aa, Artificial Sequence
  Description of Artificial Sequence: Synthetic peptide
  XENP019503 vhCDR3
TGWLGPFDY

SEQ ID NO: 9800 - protein, 215 aa, Artificial Sequence
  Description of Artificial Sequence: Synthetic polypeptide
  XENP019503 [CTLA-4]_H0_L0.84_Fab Light Chain
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9801 - protein, 108 aa, Artificial Sequence; identical to SEQ ID NO: 6841
  Description of Artificial Sequence: Synthetic polypeptide
  VL of XENP019503

SEQ ID NO: 9802 - protein, 12 aa, Artificial Sequence
  Description of Artificial Sequence: Synthetic peptide
  XENP019503 vlCDR1
RASQSVGSSYLA

SEQ ID NO: 9803 - protein, 7 aa, Artificial Sequence
  Description of Artificial Sequence: Synthetic peptide
  XENP019503 vlCDR2
GAFSRAT

SEQ ID NO: 9804 - protein, 9 aa, Artificial Sequence
  Description of Artificial Sequence: Synthetic peptide
  XENP019503 vlCDR3
QQYGSSPWT

SEQ ID NO: 9805 - protein, 221 aa, Artificial Sequence; identical to SEQ ID NO: 7595
  Description of Artificial Sequence: Synthetic polypeptide
  XENP019504 [CTLA-4]_H0_L0.85_Fab Heavy Chain

SEQ ID NO: 9806 - protein, 118 aa, Artificial Sequence; identical to SEQ ID NO: 3737
  Description of Artificial Sequence: Synthetic polypeptide
  VH of XENP019504

SEQ ID NO: 9807 - protein, 5 aa, Artificial Sequence
  Description of Artificial Sequence: Synthetic peptide
  XENP019504 vhCDR1
SYTMH

SEQ ID NO: 9808 - protein, 17 aa, Artificial Sequence
  Description of Artificial Sequence: Synthetic peptide
  XENP019504 vhCDR2
FISYDGNNKYYADSVKG

SEQ ID NO: 9809 - protein, 9 aa, Artificial Sequence
  Description of Artificial Sequence: Synthetic peptide
  XENP019504 vhCDR3
TGWLGPFDY

SEQ ID NO: 9810 - protein, 215 aa, Artificial Sequence
  Description of Artificial Sequence: Synthetic polypeptide
  XENP019504 [CTLA-4]_H0_L0.85_Fab Light Chain
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9811 - protein, 108 aa, Artificial Sequence; identical to SEQ ID NO: 6850
  Description of Artificial Sequence: Synthetic polypeptide
  VL of XENP019504

SEQ ID NO: 9812 - protein, 12 aa, Artificial Sequence
  Description of Artificial Sequence: Synthetic peptide
  XENP019504 vlCDR1
RASQSVGSSYLA

SEQ ID NO: 9813 - protein, 7 aa, Artificial Sequence
  Description of Artificial Sequence: Synthetic peptide
  XENP019504 vlCDR2
GAFSRAT

SEQ ID NO: 9814 - protein, 9 aa, Artificial Sequence
  Description of Artificial Sequence: Synthetic peptide
  XENP019504 vlCDR3
QQYGSSPWT

SEQ ID NO: 9815 - protein, 221 aa, Artificial Sequence; identical to SEQ ID NO: 7595
  Description of Artificial Sequence: Synthetic polypeptide
  XENP019505 [CTLA-4]_H0_L0.86_Fab Heavy Chain

SEQ ID NO: 9816 - protein, 118 aa, Artificial Sequence; identical to SEQ ID NO: 3737
  Description of Artificial Sequence: Synthetic polypeptide
  VH of XENP019505

SEQ ID NO: 9817 - protein, 5 aa, Artificial Sequence
  Description of Artificial Sequence: Synthetic peptide
  XENP019505 vhCDR1
SYTMH

SEQ ID NO: 9818 - protein, 17 aa, Artificial Sequence
  Description of Artificial Sequence: Synthetic peptide
  XENP019505 vhCDR2
FISYDGNNKYYADSVKG

SEQ ID NO: 9819 - protein, 9 aa, Artificial Sequence
  Description of Artificial Sequence: Synthetic peptide
  XENP019505 vhCDR3
TGWLGPFDY

SEQ ID NO: 9820 - protein, 215 aa, Artificial Sequence
  Description of Artificial Sequence: Synthetic polypeptide
  XENP019505 [CTLA-4]_H0_L0.86_Fab Light Chain
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9821 - protein, 108 aa, Artificial Sequence; identical to SEQ ID NO: 6859
  Description of Artificial Sequence: Synthetic polypeptide
  VL of XENP019505

SEQ ID NO: 9822 - protein, 12 aa, Artificial Sequence
  Description of Artificial Sequence: Synthetic peptide
  XENP019505 vlCDR1
RASQSVGSSYLA

SEQ ID NO: 9823 - protein, 7 aa, Artificial Sequence
  Description of Artificial Sequence: Synthetic peptide
  XENP019505 vlCDR2
GAFSRAT

SEQ ID NO: 9824 - protein, 9 aa, Artificial Sequence
  Description of Artificial Sequence: Synthetic peptide
  XENP019505 vlCDR3
QQYGSSPWT

SEQ ID NO: 9825 - protein, 221 aa, Artificial Sequence; identical to SEQ ID NO: 7595
  Description of Artificial Sequence: Synthetic polypeptide
  XENP019506 [CTLA-4]_H0_L0.87_Fab Heavy Chain

SEQ ID NO: 9826 - protein, 118 aa, Artificial Sequence; identical to SEQ ID NO: 3737
  Description of Artificial Sequence: Synthetic polypeptide
  VH of XENP019506

SEQ ID NO: 9827 - protein, 5 aa, Artificial Sequence
  Description of Artificial Sequence: Synthetic peptide
  XENP019506 vhCDR1
SYTMH

SEQ ID NO: 9828 - protein, 17 aa, Artificial Sequence
  Description of Artificial Sequence: Synthetic peptide
  XENP019506 vhCDR2
FISYDGNNKYYADSVKG

SEQ ID NO: 9829 - protein, 9 aa, Artificial Sequence
  Description of Artificial Sequence: Synthetic peptide
  XENP019506 vhCDR3
TGWLGPFDY

SEQ ID NO: 9830 - protein, 215 aa, Artificial Sequence
  Description of Artificial Sequence: Synthetic polypeptide
  XENP019506 [CTLA-4]_H0_L0.87_Fab Light Chain
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9831 - protein, 108 aa, Artificial Sequence; identical to SEQ ID NO: 6868
  Description of Artificial Sequence: Synthetic polypeptide
  VL of XENP019506

SEQ ID NO: 9832 - protein, 12 aa, Artificial Sequence
  Description of Artificial Sequence: Synthetic peptide
  XENP019506 vlCDR1
RASQSVGSSYLA

SEQ ID NO: 9833 - protein, 7 aa, Artificial Sequence
  Description of Artificial Sequence: Synthetic peptide
  XENP019506 vlCDR2
GAFSRAT

SEQ ID NO: 9834 - protein, 9 aa, Artificial Sequence
  Description of Artificial Sequence: Synthetic peptide
  XENP019506 vlCDR3
QQYGSSPWT

SEQ ID NO: 9835 - protein, 221 aa, Artificial Sequence; identical to SEQ ID NO: 7595
  Description of Artificial Sequence: Synthetic polypeptide
  XENP019507 [CTLA-4]_H0_L0.88_Fab Heavy Chain

SEQ ID NO: 9836 - protein, 118 aa, Artificial Sequence; identical to SEQ ID NO: 3737
  Description of Artificial Sequence: Synthetic polypeptide
  VH of XENP019507

SEQ ID NO: 9837 - protein, 5 aa, Artificial Sequence
  Description of Artificial Sequence: Synthetic peptide
  XENP019507 vhCDR1
SYTMH

SEQ ID NO: 9838 - protein, 17 aa, Artificial Sequence
  Description of Artificial Sequence: Synthetic peptide
  XENP019507 vhCDR2
FISYDGNNKYYADSVKG

SEQ ID NO: 9839 - protein, 9 aa, Artificial Sequence
  Description of Artificial Sequence: Synthetic peptide
  XENP019507 vhCDR3
TGWLGPFDY

SEQ ID NO: 9840 - protein, 215 aa, Artificial Sequence
  Description of Artificial Sequence: Synthetic polypeptide
  XENP019507 [CTLA-4]_H0_L0.88_Fab Light Chain
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9841 - protein, 108 aa, Artificial Sequence; identical to SEQ ID NO: 6877
  Description of Artificial Sequence: Synthetic polypeptide
  VL of XENP019507

SEQ ID NO: 9842 - protein, 12 aa, Artificial Sequence
  Description of Artificial Sequence: Synthetic peptide
  XENP019507 vlCDR1
RASQSVGSSYLA

SEQ ID NO: 9843 - protein, 7 aa, Artificial Sequence
  Description of Artificial Sequence: Synthetic peptide
  XENP019507 vlCDR2
GAFSRAT

SEQ ID NO: 9844 - protein, 9 aa, Artificial Sequence
  Description of Artificial Sequence: Synthetic peptide
  XENP019507 vlCDR3
QQYGSSPWT

SEQ ID NO: 9845 - protein, 221 aa, Artificial Sequence; identical to SEQ ID NO: 7595
  Description of Artificial Sequence: Synthetic polypeptide
  XENP019508 [CTLA-4]_H0_L0.89_Fab Heavy Chain

SEQ ID NO: 9846 - protein, 118 aa, Artificial Sequence; identical to SEQ ID NO: 3737
  Description of Artificial Sequence: Synthetic polypeptide
  VH of XENP019508

SEQ ID NO: 9847 - protein, 5 aa, Artificial Sequence
  Description of Artificial Sequence: Synthetic peptide
  XENP019508 vhCDR1
SYTMH

SEQ ID NO: 9848 - protein, 17 aa, Artificial Sequence
  Description of Artificial Sequence: Synthetic peptide
  XENP019508 vhCDR2
FISYDGNNKYYADSVKG

SEQ ID NO: 9849 - protein, 9 aa, Artificial Sequence
  Description of Artificial Sequence: Synthetic peptide
  XENP019508 vhCDR3
TGWLGPFDY

SEQ ID NO: 9850 - protein, 215 aa, Artificial Sequence
  Description of Artificial Sequence: Synthetic polypeptide
  XENP019508 [CTLA-4]_H0_L0.89_Fab Light Chain
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9851 - protein, 108 aa, Artificial Sequence; identical to SEQ ID NO: 6886
  Description of Artificial Sequence: Synthetic polypeptide
  VL of XENP019508

SEQ ID NO: 9852 - protein, 12 aa, Artificial Sequence
  Description of Artificial Sequence: Synthetic peptide
  XENP019508 vlCDR1
RASQSVGSSYLA

SEQ ID NO: 9853 - protein, 7 aa, Artificial Sequence
  Description of Artificial Sequence: Synthetic peptide
  XENP019508 vlCDR2
GAFSRAT

SEQ ID NO: 9854 - protein, 9 aa, Artificial Sequence
  Description of Artificial Sequence: Synthetic peptide
  XENP019508 vlCDR3
QQYGSSPWT

SEQ ID NO: 9855 - protein, 221 aa, Artificial Sequence; identical to SEQ ID NO: 7595
  Description of Artificial Sequence: Synthetic polypeptide
  XENP019509 [CTLA-4]_H0_L0.90_Fab Heavy Chain

SEQ ID NO: 9856 - protein, 118 aa, Artificial Sequence; identical to SEQ ID NO: 3737
  Description of Artificial Sequence: Synthetic polypeptide
  VH of XENP019509

SEQ ID NO: 9857 - protein, 5 aa, Artificial Sequence
  Description of Artificial Sequence: Synthetic peptide
  XENP019509 vhCDR1
SYTMH

SEQ ID NO: 9858 - protein, 17 aa, Artificial Sequence
  Description of Artificial Sequence: Synthetic peptide
  XENP019509 vhCDR2
FISYDGNNKYYADSVKG

SEQ ID NO: 9859 - protein, 9 aa, Artificial Sequence
  Description of Artificial Sequence: Synthetic peptide
  XENP019509 vhCDR3
TGWLGPFDY

SEQ ID NO: 9860 - protein, 215 aa, Artificial Sequence
  Description of Artificial Sequence: Synthetic polypeptide
  XENP019509 [CTLA-4]_H0_L0.90_Fab Light Chain
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9861 - protein, 108 aa, Artificial Sequence; identical to SEQ ID NO: 6895
  Description of Artificial Sequence: Synthetic polypeptide
  VL of XENP019509

SEQ ID NO: 9862 - protein, 12 aa, Artificial Sequence
  Description of Artificial Sequence: Synthetic peptide
  XENP019509 vlCDR1
RASQSVGSSYLA

SEQ ID NO: 9863 - protein, 7 aa, Artificial Sequence
  Description of Artificial Sequence: Synthetic peptide
  XENP019509 vlCDR2
GAFSRAT

SEQ ID NO: 9864 - protein, 9 aa, Artificial Sequence
  Description of Artificial Sequence: Synthetic peptide
  XENP019509 vlCDR3
QQYGSSPWT

SEQ ID NO: 9865 - protein, 221 aa, Artificial Sequence; identical to SEQ ID NO: 7595
  Description of Artificial Sequence: Synthetic polypeptide
  XENP019510 [CTLA-4]_H0_L0.91_Fab Heavy Chain

SEQ ID NO: 9866 - protein, 118 aa, Artificial Sequence; identical to SEQ ID NO: 3737
  Description of Artificial Sequence: Synthetic polypeptide
  VH of XENP019510

SEQ ID NO: 9867 - protein, 5 aa, Artificial Sequence
  Description of Artificial Sequence: Synthetic peptide
  XENP019510 vhCDR1
SYTMH

SEQ ID NO: 9868 - protein, 17 aa, Artificial Sequence
  Description of Artificial Sequence: Synthetic peptide
  XENP019510 vhCDR2
FISYDGNNKYYADSVKG

SEQ ID NO: 9869 - protein, 9 aa, Artificial Sequence
  Description of Artificial Sequence: Synthetic peptide
  XENP019510 vhCDR3
TGWLGPFDY

SEQ ID NO: 9870 - protein, 215 aa, Artificial Sequence
  Description of Artificial Sequence: Synthetic polypeptide
  XENP019510 [CTLA-4]_H0_L0.91_Fab Light Chain
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9871 - protein, 108 aa, Artificial Sequence; identical to SEQ ID NO: 6904
  Description of Artificial Sequence: Synthetic polypeptide
  VL of XENP019510

SEQ ID NO: 9872 - protein, 12 aa, Artificial Sequence
  Description of Artificial Sequence: Synthetic peptide
  XENP019510 vlCDR1
RASQSVGSSYLA

SEQ ID NO: 9873 - protein, 7 aa, Artificial Sequence
  Description of Artificial Sequence: Synthetic peptide
  XENP019510 vlCDR2
GAFSRAT

SEQ ID NO: 9874 - protein, 9 aa, Artificial Sequence
  Description of Artificial Sequence: Synthetic peptide
  XENP019510 vlCDR3
QQYGSSPWT

SEQ ID NO: 9875 - protein, 221 aa, Artificial Sequence; identical to SEQ ID NO: 7595
  Description of Artificial Sequence: Synthetic polypeptide
  XENP019511 [CTLA-4]_H0_L0.92_Fab Heavy Chain

SEQ ID NO: 9876 - protein, 118 aa, Artificial Sequence; identical to SEQ ID NO: 3737
  Description of Artificial Sequence: Synthetic polypeptide
  VH of XENP019511

SEQ ID NO: 9877 - protein, 5 aa, Artificial Sequence
  Description of Artificial Sequence: Synthetic peptide
  XENP019511 vhCDR1
SYTMH

SEQ ID NO: 9878 - protein, 17 aa, Artificial Sequence
  Description of Artificial Sequence: Synthetic peptide
  XENP019511 vhCDR2
FISYDGNNKYYADSVKG

SEQ ID NO: 9879 - protein, 9 aa, Artificial Sequence
  Description of Artificial Sequence: Synthetic peptide
  XENP019511 vhCDR3
TGWLGPFDY

SEQ ID NO: 9880 - protein, 215 aa, Artificial Sequence
  Description of Artificial Sequence: Synthetic polypeptide
  XENP019511 [CTLA-4]_H0_L0.92_Fab Light Chain
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9881 - protein, 108 aa, Artificial Sequence; identical to SEQ ID NO: 6913
  Description of Artificial Sequence: Synthetic polypeptide
  VL of XENP019511

SEQ ID NO: 9882 - protein, 12 aa, Artificial Sequence
  Description of Artificial Sequence: Synthetic peptide
  XENP019511 vlCDR1
RASQSVGSSYLA

SEQ ID NO: 9883 - protein, 7 aa, Artificial Sequence
  Description of Artificial Sequence: Synthetic peptide
  XENP019511 vlCDR2
GAFSRAT

SEQ ID NO: 9884 - protein, 9 aa, Artificial Sequence
  Description of Artificial Sequence: Synthetic peptide
  XENP019511 vlCDR3
QQYGSSPWT

SEQ ID NO: 9885 - protein, 221 aa, Artificial Sequence; identical to SEQ ID NO: 7595
  Description of Artificial Sequence: Synthetic polypeptide
  XENP019512 [CTLA-4]_H0_L0.93_Fab Heavy Chain

SEQ ID NO: 9886 - protein, 118 aa, Artificial Sequence; identical to SEQ ID NO: 3737
  Description of Artificial Sequence: Synthetic polypeptide
  VH of XENP019512

SEQ ID NO: 9887 - protein, 5 aa, Artificial Sequence
  Description of Artificial Sequence: Synthetic peptide
  XENP019512 vhCDR1
SYTMH

SEQ ID NO: 9888 - protein, 17 aa, Artificial Sequence
  Description of Artificial Sequence: Synthetic peptide
  XENP019512 vhCDR2
FISYDGNNKYYADSVKG

SEQ ID NO: 9889 - protein, 9 aa, Artificial Sequence
  Description of Artificial Sequence: Synthetic peptide
  XENP019512 vhCDR3
TGWLGPFDY

SEQ ID NO: 9890 - protein, 215 aa, Artificial Sequence
  Description of Artificial Sequence: Synthetic polypeptide
  XENP019512 [CTLA-4]_H0_L0.93_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9891 - protein, 108 aa, Artificial Sequence; identical to SEQ ID NO: 6922
  Description of Artificial Sequence: Synthetic polypeptide
  VL of XENP019512

SEQ ID NO: 9892 - protein, 12 aa, Artificial Sequence
  Description of Artificial Sequence: Synthetic peptide
  XENP019512 vlCDR1
RASQSVGSSYLA

SEQ ID NO: 9893 - protein, 7 aa, Artificial Sequence
  Description of Artificial Sequence: Synthetic peptide
  XENP019512 vlCDR2
GAFSRAT

SEQ ID NO: 9894 - protein, 9 aa, Artificial Sequence
  Description of Artificial Sequence: Synthetic peptide
  XENP019512 vlCDR3
KQYGSSPWT

SEQ ID NO: 9895 - protein, 221 aa, Artificial Sequence; identical to SEQ ID NO: 7595
  Description of Artificial Sequence: Synthetic polypeptide
  XENP019513 [CTLA-4]_H0_L0.94_Fab Heavy Chain

SEQ ID NO: 9896 - protein, 118 aa, Artificial Sequence; identical to SEQ ID NO: 3737
  Description of Artificial Sequence: Synthetic polypeptide
  VH of XENP019513

SEQ ID NO: 9897 - protein, 5 aa, Artificial Sequence
  Description of Artificial Sequence: Synthetic peptide
  XENP019513 vhCDR1
SYTMH

SEQ ID NO: 9898 - protein, 17 aa, Artificial Sequence
  Description of Artificial Sequence: Synthetic peptide
  XENP019513 vhCDR2
FISYDGNNKYYADSVKG

SEQ ID NO: 9899 - protein, 9 aa, Artificial Sequence
  Description of Artificial Sequence: Synthetic peptide
  XENP019513 vhCDR3
TGWLGPFDY

SEQ ID NO: 9900 - protein, 215 aa, Artificial Sequence
  Description of Artificial Sequence: Synthetic polypeptide
  XENP019513 [CTLA-4]_H0_L0.94_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9901 - protein, 108 aa, Artificial Sequence; identical to SEQ ID NO: 6931
  Description of Artificial Sequence: Synthetic polypeptide
  VL of XENP019513

SEQ ID NO: 9902 - protein, 12 aa, Artificial Sequence
  Description of Artificial Sequence: Synthetic peptide
  XENP019513 vlCDR1
RASQSVGSSYLA

SEQ ID NO: 9903 - protein, 7 aa, Artificial Sequence
  Description of Artificial Sequence: Synthetic peptide
  XENP019513 vlCDR2
GAFSRAT

SEQ ID NO: 9904 - protein, 9 aa, Artificial Sequence
  Description of Artificial Sequence: Synthetic peptide
  XENP019513 vlCDR3
LQYGSSPWT

SEQ ID NO: 9905 - protein, 221 aa, Artificial Sequence; identical to SEQ ID NO: 7595
  Description of Artificial Sequence: Synthetic polypeptide
  XENP019514 [CTLA-4]_H0_L0.95_Fab Heavy Chain

SEQ ID NO: 9906 - protein, 118 aa, Artificial Sequence; identical to SEQ ID NO: 3737
  Description of Artificial Sequence: Synthetic polypeptide
  VH of XENP019514

SEQ ID NO: 9907 - protein, 5 aa, Artificial Sequence
  Description of Artificial Sequence: Synthetic peptide
  XENP019514 vhCDR1
SYTMH

SEQ ID NO: 9908 - protein, 17 aa, Artificial Sequence
  Description of Artificial Sequence: Synthetic peptide
  XENP019514 vhCDR2
FISYDGNNKYYADSVKG

SEQ ID NO: 9909 - protein, 9 aa, Artificial Sequence
  Description of Artificial Sequence: Synthetic peptide
  XENP019514 vhCDR3
TGWLGPFDY

SEQ ID NO: 9910 - protein, 215 aa, Artificial Sequence
  Description of Artificial Sequence: Synthetic polypeptide
  XENP019514 [CTLA-4]_H0_L0.95_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9911 - protein, 108 aa, Artificial Sequence; identical to SEQ ID NO: 6940
  Description of Artificial Sequence: Synthetic polypeptide
  VL of XENP019514

SEQ ID NO: 9912 - protein, 12 aa, Artificial Sequence
  Description of Artificial Sequence: Synthetic peptide
  XENP019514 vlCDR1
RASQSVGSSYLA

SEQ ID NO: 9913 - protein, 7 aa, Artificial Sequence
  Description of Artificial Sequence: Synthetic peptide
  XENP019514 vlCDR2
GAFSRAT

SEQ ID NO: 9914 - protein, 9 aa, Artificial Sequence
  Description of Artificial Sequence: Synthetic peptide
  XENP019514 vlCDR3
MQYGSSPWT

SEQ ID NO: 9915 - protein, 221 aa, Artificial Sequence; identical to SEQ ID NO: 7595
  Description of Artificial Sequence: Synthetic polypeptide
  XENP019515 [CTLA-4]_H0_L0.96_Fab Heavy Chain

SEQ ID NO: 9916 - protein, 118 aa, Artificial Sequence; identical to SEQ ID NO: 3737
  Description of Artificial Sequence: Synthetic polypeptide
  VH of XENP019515

SEQ ID NO: 9917 - protein, 5 aa, Artificial Sequence
  Description of Artificial Sequence: Synthetic peptide
  XENP019515 vhCDR1
SYTMH

SEQ ID NO: 9918 - protein, 17 aa, Artificial Sequence
  Description of Artificial Sequence: Synthetic peptide
  XENP019515 vhCDR2
FISYDGNNKYYADSVKG

SEQ ID NO: 9919 - protein, 9 aa, Artificial Sequence
  Description of Artificial Sequence: Synthetic peptide
  XENP019515 vhCDR3
TGWLGPFDY

SEQ ID NO: 9920 - protein, 215 aa, Artificial Sequence
  Description of Artificial Sequence: Synthetic polypeptide
  XENP019515 [CTLA-4]_H0_L0.96_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9921 - protein, 108 aa, Artificial Sequence; identical to SEQ ID NO: 6949
  Description of Artificial Sequence: Synthetic polypeptide
  VL of XENP019515

SEQ ID NO: 9922 - protein, 12 aa, Artificial Sequence
  Description of Artificial Sequence: Synthetic peptide
  XENP019515 vlCDR1
RASQSVGSSYLA

SEQ ID NO: 9923 - protein, 7 aa, Artificial Sequence
  Description of Artificial Sequence: Synthetic peptide
  XENP019515 vlCDR2
GAFSRAT

SEQ ID NO: 9924 - protein, 9 aa, Artificial Sequence
  Description of Artificial Sequence: Synthetic peptide
  XENP019515 vlCDR3
QSYGSSPWT

SEQ ID NO: 9925 - protein, 221 aa, Artificial Sequence; identical to SEQ ID NO: 7595
  Description of Artificial Sequence: Synthetic polypeptide
  XENP019516 [CTLA-4]_H0_L0.97_Fab Heavy Chain

SEQ ID NO: 9926 - protein, 118 aa, Artificial Sequence; identical to SEQ ID NO: 3737
  Description of Artificial Sequence: Synthetic polypeptide
  VH of XENP019516

SEQ ID NO: 9927 - protein, 5 aa, Artificial Sequence
  Description of Artificial Sequence: Synthetic peptide
  XENP019516 vhCDR1
SYTMH

SEQ ID NO: 9928 - protein, 17 aa, Artificial Sequence
  Description of Artificial Sequence: Synthetic peptide
  XENP019516 vhCDR2
FISYDGNNKYYADSVKG

SEQ ID NO: 9929 - protein, 9 aa, Artificial Sequence
  Description of Artificial Sequence: Synthetic peptide
  XENP019516 vhCDR3
TGWLGPFDY

SEQ ID NO: 9930 - protein, 215 aa, Artificial Sequence
  Description of Artificial Sequence: Synthetic polypeptide
  XENP019516 [CTLA-4]_H0_L0.97_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9931 - protein, 108 aa, Artificial Sequence; identical to SEQ ID NO: 6958
  Description of Artificial Sequence: Synthetic polypeptide
  VL of XENP019516

SEQ ID NO: 9932 - protein, 12 aa, Artificial Sequence
  Description of Artificial Sequence: Synthetic peptide
  XENP019516 vlCDR1
RASQSVGSSYLA

SEQ ID NO: 9933 - protein, 7 aa, Artificial Sequence
  Description of Artificial Sequence: Synthetic peptide
  XENP019516 vlCDR2
GAFSRAT

SEQ ID NO: 9934 - protein, 9 aa, Artificial Sequence
  Description of Artificial Sequence: Synthetic peptide
  XENP019516 vlCDR3
QQAGSSPWT

SEQ ID NO: 9935 - protein, 221 aa, Artificial Sequence; identical to SEQ ID NO: 7595
  Description of Artificial Sequence: Synthetic polypeptide
  XENP019517 [CTLA-4]_H0_L0.98_Fab Heavy Chain

SEQ ID NO: 9936 - protein, 118 aa, Artificial Sequence; identical to SEQ ID NO: 3737
  Description of Artificial Sequence: Synthetic polypeptide
  VH of XENP019517

SEQ ID NO: 9937 - protein, 5 aa, Artificial Sequence
  Description of Artificial Sequence: Synthetic peptide
  XENP019517 vhCDR1
SYTMH

SEQ ID NO: 9938 - protein, 17 aa, Artificial Sequence
  Description of Artificial Sequence: Synthetic peptide
  XENP019517 vhCDR2
FISYDGNNKYYADSVKG

SEQ ID NO: 9939 - protein, 9 aa, Artificial Sequence
  Description of Artificial Sequence: Synthetic peptide
  XENP019517 vhCDR3
TGWLGPFDY

SEQ ID NO: 9940 - protein, 215 aa, Artificial Sequence
  Description of Artificial Sequence: Synthetic polypeptide
  XENP019517 [CTLA-4]_H0_L0.98_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9941 - protein, 108 aa, Artificial Sequence; identical to SEQ ID NO: 6967
  Description of Artificial Sequence: Synthetic polypeptide
  VL of XENP019517

SEQ ID NO: 9942 - protein, 12 aa, Artificial Sequence
  Description of Artificial Sequence: Synthetic peptide
  XENP019517 vlCDR1
RASQSVGSSYLA

SEQ ID NO: 9943 - protein, 7 aa, Artificial Sequence
  Description of Artificial Sequence: Synthetic peptide
  XENP019517 vlCDR2
GAFSRAT

SEQ ID NO: 9944 - protein, 9 aa, Artificial Sequence
  Description of Artificial Sequence: Synthetic peptide
  XENP019517 vlCDR3
QQFGSSPWT

SEQ ID NO: 9945 - protein, 221 aa, Artificial Sequence; identical to SEQ ID NO: 7595
  Description of Artificial Sequence: Synthetic polypeptide
  XENP019518 [CTLA-4]_H0_L0.99_Fab Heavy Chain

SEQ ID NO: 9946 - protein, 118 aa, Artificial Sequence; identical to SEQ ID NO: 3737
  Description of Artificial Sequence: Synthetic polypeptide
  VH of XENP019518

SEQ ID NO: 9947 - protein, 5 aa, Artificial Sequence
  Description of Artificial Sequence: Synthetic peptide
  XENP019518 vhCDR1
SYTMH

SEQ ID NO: 9948 - protein, 17 aa, Artificial Sequence
  Description of Artificial Sequence: Synthetic peptide
  XENP019518 vhCDR2
FISYDGNNKYYADSVKG

SEQ ID NO: 9949 - protein, 9 aa, Artificial Sequence
  Description of Artificial Sequence: Synthetic peptide
  XENP019518 vhCDR3
TGWLGPFDY

SEQ ID NO: 9950 - protein, 215 aa, Artificial Sequence
  Description of Artificial Sequence: Synthetic polypeptide
  XENP019518 [CTLA-4]_H0_L0.99_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9951 - protein, 108 aa, Artificial Sequence; identical to SEQ ID NO: 6976
  Description of Artificial Sequence: Synthetic polypeptide
  VL of XENP019518

SEQ ID NO: 9952 - protein, 12 aa, Artificial Sequence
  Description of Artificial Sequence: Synthetic peptide
  XENP019518 vlCDR1
RASQSVGSSYLA

SEQ ID NO: 9953 - protein, 7 aa, Artificial Sequence
  Description of Artificial Sequence: Synthetic peptide
  XENP019518 vlCDR2
GAFSRAT

SEQ ID NO: 9954 - protein, 9 aa, Artificial Sequence
  Description of Artificial Sequence: Synthetic peptide
  XENP019518 vlCDR3
QQHGSSPWT

SEQ ID NO: 9955 - protein, 221 aa, Artificial Sequence; identical to SEQ ID NO: 7595
  Description of Artificial Sequence: Synthetic polypeptide
  XENP019519 [CTLA-4]_H0_L0.100_Fab Heavy Chain

SEQ ID NO: 9956 - protein, 118 aa, Artificial Sequence; identical to SEQ ID NO: 3737
  Description of Artificial Sequence: Synthetic polypeptide
  VH of XENP019519

SEQ ID NO: 9957 - protein, 5 aa, Artificial Sequence
  Description of Artificial Sequence: Synthetic peptide
  XENP019519 vhCDR1
SYTMH

SEQ ID NO: 9958 - protein, 17 aa, Artificial Sequence
  Description of Artificial Sequence: Synthetic peptide
  XENP019519 vhCDR2
FISYDGNNKYYADSVKG

SEQ ID NO: 9959 - protein, 9 aa, Artificial Sequence
  Description of Artificial Sequence: Synthetic peptide
  XENP019519 vhCDR3
TGWLGPFDY

SEQ ID NO: 9960 - protein, 215 aa, Artificial Sequence
  Description of Artificial Sequence: Synthetic polypeptide
  XENP019519 [CTLA-4]_H0_L0.100_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9961 - protein, 108 aa, Artificial Sequence; identical to SEQ ID NO: 6985
  Description of Artificial Sequence: Synthetic polypeptide
  VL of XENP019519

SEQ ID NO: 9962 - protein, 12 aa, Artificial Sequence
  Description of Artificial Sequence: Synthetic peptide
  XENP019519 vlCDR1
RASQSVGSSYLA

SEQ ID NO: 9963 - protein, 7 aa, Artificial Sequence
  Description of Artificial Sequence: Synthetic peptide
  XENP019519 vlCDR2
GAFSRAT

SEQ ID NO: 9964 - protein, 9 aa, Artificial Sequence
  Description of Artificial Sequence: Synthetic peptide
  XENP019519 vlCDR3
QQLGSSPWT

SEQ ID NO: 9965 - protein, 221 aa, Artificial Sequence; identical to SEQ ID NO: 7595
  Description of Artificial Sequence: Synthetic polypeptide
  XENP019520 [CTLA-4]_H0_L0.101_Fab Heavy Chain

SEQ ID NO: 9966 - protein, 118 aa, Artificial Sequence; identical to SEQ ID NO: 3737
  Description of Artificial Sequence: Synthetic polypeptide
  VH of XENP019520

SEQ ID NO: 9967 - protein, 5 aa, Artificial Sequence
  Description of Artificial Sequence: Synthetic peptide
  XENP019520 vhCDR1
SYTMH

SEQ ID NO: 9968 - protein, 17 aa, Artificial Sequence
  Description of Artificial Sequence: Synthetic peptide
  XENP019520 vhCDR2
FISYDGNNKYYADSVKG

SEQ ID NO: 9969 - protein, 9 aa, Artificial Sequence
  Description of Artificial Sequence: Synthetic peptide
  XENP019520 vhCDR3
TGWLGPFDY

SEQ ID NO: 9970 - protein, 215 aa, Artificial Sequence
  Description of Artificial Sequence: Synthetic polypeptide
  XENP019520 [CTLA-4]_H0_L0.101_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9971 - protein, 108 aa, Artificial Sequence; identical to SEQ ID NO: 6994
  Description of Artificial Sequence: Synthetic polypeptide
  VL of XENP019520

SEQ ID NO: 9972 - protein, 12 aa, Artificial Sequence
  Description of Artificial Sequence: Synthetic peptide
  XENP019520 vlCDR1
RASQSVGSSYLA

SEQ ID NO: 9973 - protein, 7 aa, Artificial Sequence
  Description of Artificial Sequence: Synthetic peptide
  XENP019520 vlCDR2
GAFSRAT

SEQ ID NO: 9974 - protein, 9 aa, Artificial Sequence
  Description of Artificial Sequence: Synthetic peptide
  XENP019520 vlCDR3
QQVGSSPWT

SEQ ID NO: 9975 - protein, 221 aa, Artificial Sequence; identical to SEQ ID NO: 7595
  Description of Artificial Sequence: Synthetic polypeptide
  XENP019521 [CTLA-4]_H0_L0.102_Fab Heavy Chain

SEQ ID NO: 9976 - protein, 118 aa, Artificial Sequence; identical to SEQ ID NO: 3737
  Description of Artificial Sequence: Synthetic polypeptide
  VH of XENP019521

SEQ ID NO: 9977 - protein, 5 aa, Artificial Sequence
  Description of Artificial Sequence: Synthetic peptide
  XENP019521 vhCDR1
SYTMH

SEQ ID NO: 9978 - protein, 17 aa, Artificial Sequence
  Description of Artificial Sequence: Synthetic peptide
  XENP019521 vhCDR2
FISYDGNNKYYADSVKG

SEQ ID NO: 9979 - protein, 9 aa, Artificial Sequence
  Description of Artificial Sequence: Synthetic peptide
  XENP019521 vhCDR3
TGWLGPFDY

SEQ ID NO: 9980 - protein, 215 aa, Artificial Sequence
  Description of Artificial Sequence: Synthetic polypeptide
  XENP019521 [CTLA-4]_H0_L0.102_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9981 - protein, 108 aa, Artificial Sequence; identical to SEQ ID NO: 7003
  Description of Artificial Sequence: Synthetic polypeptide
  VL of XENP019521

SEQ ID NO: 9982 - protein, 12 aa, Artificial Sequence
  Description of Artificial Sequence: Synthetic peptide
  XENP019521 vlCDR1
RASQSVGSSYLA

SEQ ID NO: 9983 - protein, 7 aa, Artificial Sequence
  Description of Artificial Sequence: Synthetic peptide
  XENP019521 vlCDR2
GAFSRAT

SEQ ID NO: 9984 - protein, 9 aa, Artificial Sequence
  Description of Artificial Sequence: Synthetic peptide
  XENP019521 vlCDR3
QQYGESPWT

SEQ ID NO: 9985 - protein, 221 aa, Artificial Sequence; identical to SEQ ID NO: 7595
  Description of Artificial Sequence: Synthetic polypeptide
  XENP019522 [CTLA-4]_H0_L0.103_Fab Heavy Chain

SEQ ID NO: 9986 - protein, 118 aa, Artificial Sequence; identical to SEQ ID NO: 3737
  Description of Artificial Sequence: Synthetic polypeptide
  VH of XENP019522

SEQ ID NO: 9987 - protein, 5 aa, Artificial Sequence
  Description of Artificial Sequence: Synthetic peptide
  XENP019522 vhCDR1
SYTMH

SEQ ID NO: 9988 - protein, 17 aa, Artificial Sequence
  Description of Artificial Sequence: Synthetic peptide
  XENP019522 vhCDR2
FISYDGNNKYYADSVKG

SEQ ID NO: 9989 - protein, 9 aa, Artificial Sequence
  Description of Artificial Sequence: Synthetic peptide
  XENP019522 vhCDR3
TGWLGPFDY

SEQ ID NO: 9990 - protein, 215 aa, Artificial Sequence
  Description of Artificial Sequence: Synthetic polypeptide
  XENP019522 [CTLA-4]_H0_L0.103_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9991 - protein, 108 aa, Artificial Sequence; identical to SEQ ID NO: 7012
  Description of Artificial Sequence: Synthetic polypeptide
  VL of XENP019522

SEQ ID NO: 9992 - protein, 12 aa, Artificial Sequence
  Description of Artificial Sequence: Synthetic peptide
  XENP019522 vlCDR1
RASQSVGSSYLA

SEQ ID NO: 9993 - protein, 7 aa, Artificial Sequence
  Description of Artificial Sequence: Synthetic peptide
  XENP019522 vlCDR2
GAFSRAT

SEQ ID NO: 9994 - protein, 9 aa, Artificial Sequence
  Description of Artificial Sequence: Synthetic peptide
  XENP019522 vlCDR3
QQYGKSPWT

SEQ ID NO: 9995 - protein, 221 aa, Artificial Sequence; identical to SEQ ID NO: 7595
  Description of Artificial Sequence: Synthetic polypeptide
  XENP019523 [CTLA-4]_H0_L0.104_Fab Heavy Chain

SEQ ID NO: 9996 - protein, 118 aa, Artificial Sequence; identical to SEQ ID NO: 3737
  Description of Artificial Sequence: Synthetic polypeptide
  VH of XENP019523

SEQ ID NO: 9997 - protein, 5 aa, Artificial Sequence
  Description of Artificial Sequence: Synthetic peptide
  XENP019523 vhCDR1
SYTMH

SEQ ID NO: 9998 - protein, 17 aa, Artificial Sequence
  Description of Artificial Sequence: Synthetic peptide
  XENP019523 vhCDR2
FISYDGNNKYYADSVKG

SEQ ID NO: 9999 - protein, 9 aa, Artificial Sequence
  Description of Artificial Sequence: Synthetic peptide
  XENP019523 vhCDR3
TGWLGPFDY

SEQ ID NO: 10000 - protein, 215 aa, Artificial Sequence
  Description of Artificial Sequence: Synthetic polypeptide
  XENP019523 [CTLA-4]_H0_L0.104_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10001 - protein, 108 aa, Artificial Sequence; identical to SEQ ID NO: 7021
  Description of Artificial Sequence: Synthetic polypeptide
  VL of XENP019523

SEQ ID NO: 10002 - protein, 12 aa, Artificial Sequence
  Description of Artificial Sequence: Synthetic peptide
  XENP019523 vlCDR1
RASQSVGSSYLA

SEQ ID NO: 10003 - protein, 7 aa, Artificial Sequence
  Description of Artificial Sequence: Synthetic peptide
  XENP019523 vlCDR2
GAFSRAT

SEQ ID NO: 10004 - protein, 9 aa, Artificial Sequence
  Description of Artificial Sequence: Synthetic peptide
  XENP019523 vlCDR3
QQYGSYPWT

SEQ ID NO: 10005 - protein, 221 aa, Artificial Sequence; identical to SEQ ID NO: 7595
  Description of Artificial Sequence: Synthetic polypeptide
  XENP019524 [CTLA-4]_H0_L0.105_Fab Heavy Chain

SEQ ID NO: 10006 - protein, 118 aa, Artificial Sequence; identical to SEQ ID NO: 3737
  Description of Artificial Sequence: Synthetic polypeptide
  VH of XENP019524

SEQ ID NO: 10007 - protein, 5 aa, Artificial Sequence
  Description of Artificial Sequence: Synthetic peptide
  XENP019524 vhCDR1
SYTMH

SEQ ID NO: 10008 - protein, 17 aa, Artificial Sequence
  Description of Artificial Sequence: Synthetic peptide
  XENP019524 vhCDR2
FISYDGNNKYYADSVKG

SEQ ID NO: 10009 - protein, 9 aa, Artificial Sequence
  Description of Artificial Sequence: Synthetic peptide
  XENP019524 vhCDR3
TGWLGPFDY

SEQ ID NO: 10010 - protein, 215 aa, Artificial Sequence
  Description of Artificial Sequence: Synthetic polypeptide
  XENP019524 [CTLA-4]_H0_L0.105_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10011 - protein, 108 aa, Artificial Sequence; identical to SEQ ID NO: 7030
  Description of Artificial Sequence: Synthetic polypeptide
  VL of XENP019524

SEQ ID NO: 10012 - protein, 12 aa, Artificial Sequence
  Description of Artificial Sequence: Synthetic peptide
  XENP019524 vlCDR1
RASQSVGSSYLA

SEQ ID NO: 10013 - protein, 7 aa, Artificial Sequence
  Description of Artificial Sequence: Synthetic peptide
  XENP019524 vlCDR2
GAFSRAT

SEQ ID NO: 10014 - protein, 9 aa, Artificial Sequence
  Description of Artificial Sequence: Synthetic peptide
  XENP019524 vlCDR3
QQYGSSHWT

SEQ ID NO: 10015 - protein, 221 aa, Artificial Sequence; identical to SEQ ID NO: 7595
  Description of Artificial Sequence: Synthetic polypeptide
  XENP019525 [CTLA-4]_H0_L0.106_Fab Heavy Chain

SEQ ID NO: 10016 - protein, 118 aa, Artificial Sequence; identical to SEQ ID NO: 3737
  Description of Artificial Sequence: Synthetic polypeptide
  VH of XENP019525

SEQ ID NO: 10017 - protein, 5 aa, Artificial Sequence
  Description of Artificial Sequence: Synthetic peptide
  XENP019525 vhCDR1
SYTMH

SEQ ID NO: 10018 - protein, 17 aa, Artificial Sequence
  Description of Artificial Sequence: Synthetic peptide
  XENP019525 vhCDR2
FISYDGNNKYYADSVKG

SEQ ID NO: 10019 - protein, 9 aa, Artificial Sequence
  Description of Artificial Sequence: Synthetic peptide
  XENP019525 vhCDR3
TGWLGPFDY

SEQ ID NO: 10020 - protein, 215 aa, Artificial Sequence
  Description of Artificial Sequence: Synthetic polypeptide
  XENP019525 [CTLA-4]_H0_L0.106_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10021 - protein, 108 aa, Artificial Sequence; identical to SEQ ID NO: 7039
  Description of Artificial Sequence: Synthetic polypeptide
  VL of XENP019525

SEQ ID NO: 10022 - protein, 12 aa, Artificial Sequence
  Description of Artificial Sequence: Synthetic peptide
  XENP019525 vlCDR1
RASQSVGSSYLA

SEQ ID NO: 10023 - protein, 7 aa, Artificial Sequence
  Description of Artificial Sequence: Synthetic peptide
  XENP019525 vlCDR2
GAFSRAT

SEQ ID NO: 10024 - protein, 9 aa, Artificial Sequence
  Description of Artificial Sequence: Synthetic peptide
  XENP019525 vlCDR3
QQYGSSPFT

SEQ ID NO: 10025 - protein, 221 aa, Artificial Sequence; identical to SEQ ID NO: 7595
  Description of Artificial Sequence: Synthetic polypeptide
  XENP019526 [CTLA-4]_H0_L0.107_Fab Heavy Chain

SEQ ID NO: 10026 - protein, 118 aa, Artificial Sequence; identical to SEQ ID NO: 3737
  Description of Artificial Sequence: Synthetic polypeptide
  VH of XENP019526

SEQ ID NO: 10027 - protein, 5 aa, Artificial Sequence
  Description of Artificial Sequence: Synthetic peptide
  XENP019526 vhCDR1
SYTMH

SEQ ID NO: 10028 - protein, 17 aa, Artificial Sequence
  Description of Artificial Sequence: Synthetic peptide
  XENP019526 vhCDR2
FISYDGNNKYYADSVKG

SEQ ID NO: 10029 - protein, 9 aa, Artificial Sequence
  Description of Artificial Sequence: Synthetic peptide
  XENP019526 vhCDR3
TGWLGPFDY

SEQ ID NO: 10030 - protein, 215 aa, Artificial Sequence
  Description of Artificial Sequence: Synthetic polypeptide
  XENP019526 [CTLA-4]_H0_L0.107_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10031 - protein, 108 aa, Artificial Sequence; identical to SEQ ID NO: 7048
  Description of Artificial Sequence: Synthetic polypeptide
  VL of XENP019526

SEQ ID NO: 10032 - protein, 12 aa, Artificial Sequence
  Description of Artificial Sequence: Synthetic peptide
  XENP019526 vlCDR1
RASQSVGSSYLA

SEQ ID NO: 10033 - protein, 7 aa, Artificial Sequence
  Description of Artificial Sequence: Synthetic peptide
  XENP019526 vlCDR2
GAFSRAT

SEQ ID NO: 10034 - protein, 9 aa, Artificial Sequence
  Description of Artificial Sequence: Synthetic peptide
  XENP019526 vlCDR3
QQYGSSPHT

SEQ ID NO: 10035 - protein, 221 aa, Artificial Sequence; identical to SEQ ID NO: 7595
  Description of Artificial Sequence: Synthetic polypeptide
  XENP019527 [CTLA-4]_H0_L0.108_Fab Heavy Chain

SEQ ID NO: 10036 - protein, 118 aa, Artificial Sequence; identical to SEQ ID NO: 3737
  Description of Artificial Sequence: Synthetic polypeptide
  VH of XENP019527

SEQ ID NO: 10037 - protein, 5 aa, Artificial Sequence
  Description of Artificial Sequence: Synthetic peptide
  XENP019527 vhCDR1
SYTMH

SEQ ID NO: 10038 - protein, 17 aa, Artificial Sequence
  Description of Artificial Sequence: Synthetic peptide
  XENP019527 vhCDR2
FISYDGNNKYYADSVKG

SEQ ID NO: 10039 - protein, 9 aa, Artificial Sequence
  Description of Artificial Sequence: Synthetic peptide
  XENP019527 vhCDR3
TGWLGPFDY

SEQ ID NO: 10040 - protein, 215 aa, Artificial Sequence
  Description of Artificial Sequence: Synthetic polypeptide
  XENP019527 [CTLA-4]_H0_L0.108_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10041 - protein, 108 aa, Artificial Sequence; identical to SEQ ID NO: 7057
  Description of Artificial Sequence: Synthetic polypeptide
  VL of XENP019527

SEQ ID NO: 10042 - protein, 12 aa, Artificial Sequence
  Description of Artificial Sequence: Synthetic peptide
  XENP019527 vlCDR1
RASQSVGSSYLA

SEQ ID NO: 10043 - protein, 7 aa, Artificial Sequence
  Description of Artificial Sequence: Synthetic peptide
  XENP019527 vlCDR2
GAFSRAT

SEQ ID NO: 10044 - protein, 9 aa, Artificial Sequence
  Description of Artificial Sequence: Synthetic peptide
  XENP019527 vlCDR3
QQYGSSPIT

SEQ ID NO: 10045 - protein, 221 aa, Artificial Sequence; identical to SEQ ID NO: 7595
  Description of Artificial Sequence: Synthetic polypeptide
  XENP019528 [CTLA-4]_H0_L0.109_Fab Heavy Chain

SEQ ID NO: 10046 - protein, 118 aa, Artificial Sequence; identical to SEQ ID NO: 3737
  Description of Artificial Sequence: Synthetic polypeptide
  VH of XENP019528

SEQ ID NO: 10047 - protein, 5 aa, Artificial Sequence
  Description of Artificial Sequence: Synthetic peptide
  XENP019528 vhCDR1
SYTMH

SEQ ID NO: 10048 - protein, 17 aa, Artificial Sequence
  Description of Artificial Sequence: Synthetic peptide
  XENP019528 vhCDR2
FISYDGNNKYYADSVKG

SEQ ID NO: 10049 - protein, 9 aa, Artificial Sequence
  Description of Artificial Sequence: Synthetic peptide
  XENP019528 vhCDR3
TGWLGPFDY

SEQ ID NO: 10050 - protein, 215 aa, Artificial Sequence
  Description of Artificial Sequence: Synthetic polypeptide
  XENP019528 [CTLA-4]_H0_L0.109_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10051 - protein, 108 aa, Artificial Sequence; identical to SEQ ID NO: 7066
  Description of Artificial Sequence: Synthetic polypeptide
  VL of XENP019528

SEQ ID NO: 10052 - protein, 12 aa, Artificial Sequence
  Description of Artificial Sequence: Synthetic peptide
  XENP019528 vlCDR1
RASQSVGSSYLA

SEQ ID NO: 10053 - protein, 7 aa, Artificial Sequence
  Description of Artificial Sequence: Synthetic peptide
  XENP019528 vlCDR2
GAFSRAT

SEQ ID NO: 10054 - protein, 9 aa, Artificial Sequence
  Description of Artificial Sequence: Synthetic peptide
  XENP019528 vlCDR3
QQYGSSPLT

SEQ ID NO: 10055 - protein, 221 aa, Artificial Sequence; identical to SEQ ID NO: 7595
  Description of Artificial Sequence: Synthetic polypeptide
  XENP019529 [CTLA-4]_H0_L0.110_Fab Heavy Chain

SEQ ID NO: 10056 - protein, 118 aa, Artificial Sequence; identical to SEQ ID NO: 3737
  Description of Artificial Sequence: Synthetic polypeptide
  VH of XENP019529

SEQ ID NO: 10057 - protein, 5 aa, Artificial Sequence
  Description of Artificial Sequence: Synthetic peptide
  XENP019529 vhCDR1
SYTMH

SEQ ID NO: 10058 - protein, 17 aa, Artificial Sequence
  Description of Artificial Sequence: Synthetic peptide
  XENP019529 vhCDR2
FISYDGNNKYYADSVKG

SEQ ID NO: 10059 - protein, 9 aa, Artificial Sequence
  Description of Artificial Sequence: Synthetic peptide
  XENP019529 vhCDR3
TGWLGPFDY

SEQ ID NO: 10060 - protein, 215 aa, Artificial Sequence
  Description of Artificial Sequence: Synthetic polypeptide
  XENP019529 [CTLA-4]_H0_L0.110_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10061 - protein, 108 aa, Artificial Sequence; identical to SEQ ID NO: 7075
  Description of Artificial Sequence: Synthetic polypeptide
  VL of XENP019529

SEQ ID NO: 10062 - protein, 12 aa, Artificial Sequence
  Description of Artificial Sequence: Synthetic peptide
  XENP019529 vlCDR1
RASQSVGSSYLA

SEQ ID NO: 10063 - protein, 7 aa, Artificial Sequence
  Description of Artificial Sequence: Synthetic peptide
  XENP019529 vlCDR2
GAFSRAT

SEQ ID NO: 10064 - protein, 9 aa, Artificial Sequence
  Description of Artificial Sequence: Synthetic peptide
  XENP019529 vlCDR3
QQYGSSPYT

SEQ ID NO: 10065 - protein, 221 aa, Artificial Sequence; identical to SEQ ID NO: 7595
  Description of Artificial Sequence: Synthetic polypeptide
  XENP019530 [CTLA-4]_H0_L0.111_Fab Heavy Chain

SEQ ID NO: 10066 - protein, 118 aa, Artificial Sequence; identical to SEQ ID NO: 3737
  Description of Artificial Sequence: Synthetic polypeptide
  VH of XENP019530

SEQ ID NO: 10067 - protein, 5 aa, Artificial Sequence
  Description of Artificial Sequence: Synthetic peptide
  XENP019530 vhCDR1
SYTMH

SEQ ID NO: 10068 - protein, 17 aa, Artificial Sequence
  Description of Artificial Sequence: Synthetic peptide
  XENP019530 vhCDR2
FISYDGNNKYYADSVKG

SEQ ID NO: 10069 - protein, 9 aa, Artificial Sequence
  Description of Artificial Sequence: Synthetic peptide
  XENP019530 vhCDR3
TGWLGPFDY

SEQ ID NO: 10070 - protein, 215 aa, Artificial Sequence
  Description of Artificial Sequence: Synthetic polypeptide
  XENP019530 [CTLA-4]_H0_L0.111_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10071 - protein, 108 aa, Artificial Sequence; identical to SEQ ID NO: 7084
  Description of Artificial Sequence: Synthetic polypeptide
  VL of XENP019530

SEQ ID NO: 10072 - protein, 12 aa, Artificial Sequence
  Description of Artificial Sequence: Synthetic peptide
  XENP019530 vlCDR1
RASQSVGSSYLA

SEQ ID NO: 10073 - protein, 7 aa, Artificial Sequence
  Description of Artificial Sequence: Synthetic peptide
  XENP019530 vlCDR2
GAFSRAT

SEQ ID NO: 10074 - protein, 9 aa, Artificial Sequence
  Description of Artificial Sequence: Synthetic peptide
  XENP019530 vlCDR3
QQYGSSPWV

SEQ ID NO: 10075 - protein, 221 aa, Artificial Sequence; identical to SEQ ID NO: 7595
  Description of Artificial Sequence: Synthetic polypeptide
  XENP019531 [CTLA-4]_H0_L0.112_Fab Heavy Chain

SEQ ID NO: 10076 - protein, 118 aa, Artificial Sequence; identical to SEQ ID NO: 3737
  Description of Artificial Sequence: Synthetic polypeptide
  VH of XENP019531

SEQ ID NO: 10077 - protein, 5 aa, Artificial Sequence
  Description of Artificial Sequence: Synthetic peptide
  XENP019531 vhCDR1
SYTMH

SEQ ID NO: 10078 - protein, 17 aa, Artificial Sequence
  Description of Artificial Sequence: Synthetic peptide
  XENP019531 vhCDR2
FISYDGNNKYYADSVKG

SEQ ID NO: 10079 - protein, 9 aa, Artificial Sequence
  Description of Artificial Sequence: Synthetic peptide
  XENP019531 vhCDR3
TGWLGPFDY

SEQ ID NO: 10080 - protein, 215 aa, Artificial Sequence
  Description of Artificial Sequence: Synthetic polypeptide
  XENP019531 [CTLA-4]_H0_L0.112_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10081 - protein, 108 aa, Artificial Sequence; identical to SEQ ID NO: 7093
  Description of Artificial Sequence: Synthetic polypeptide
  VL of XENP019531

SEQ ID NO: 10082 - protein, 12 aa, Artificial Sequence
  Description of Artificial Sequence: Synthetic peptide
  XENP019531 vlCDR1
RASQSVGSSYLA

SEQ ID NO: 10083 - protein, 7 aa, Artificial Sequence
  Description of Artificial Sequence: Synthetic peptide
  XENP019531 vlCDR2
GAFSRAT

SEQ ID NO: 10084 - protein, 9 aa, Artificial Sequence
  Description of Artificial Sequence: Synthetic peptide
  XENP019531 vlCDR3
QQYGSSPWT

SEQ ID NO: 10085 - protein, 221 aa, Artificial Sequence; identical to SEQ ID NO: 7595
  Description of Artificial Sequence: Synthetic polypeptide
  XENP019532 [CTLA-4]_H0_L0.113_Fab Heavy Chain

SEQ ID NO: 10086 - protein, 118 aa, Artificial Sequence; identical to SEQ ID NO: 3737
  Description of Artificial Sequence: Synthetic polypeptide
  VH of XENP019532

SEQ ID NO: 10087 - protein, 5 aa, Artificial Sequence
  Description of Artificial Sequence: Synthetic peptide
  XENP019532 vhCDR1
SYTMH

SEQ ID NO: 10088 - protein, 17 aa, Artificial Sequence
  Description of Artificial Sequence: Synthetic peptide
  XENP019532 vhCDR2
FISYDGNNKYYADSVKG

SEQ ID NO: 10089 - protein, 9 aa, Artificial Sequence
  Description of Artificial Sequence: Synthetic peptide
  XENP019532 vhCDR3
TGWLGPFDY

SEQ ID NO: 10090 - protein, 215 aa, Artificial Sequence
  Description of Artificial Sequence: Synthetic polypeptide
  XENP019532 [CTLA-4]_H0_L0.113_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10091 - protein, 108 aa, Artificial Sequence; identical to SEQ ID NO: 4735
  Description of Artificial Sequence: Synthetic polypeptide
  VL of XENP019532

SEQ ID NO: 10092 - protein, 12 aa, Artificial Sequence
  Description of Artificial Sequence: Synthetic peptide
  XENP019532 vlCDR1
RASQSVGSSYLA

SEQ ID NO: 10093 - protein, 7 aa, Artificial Sequence
  Description of Artificial Sequence: Synthetic peptide
  XENP019532 vlCDR2
GAFSRAT

SEQ ID NO: 10094 - protein, 9 aa, Artificial Sequence
  Description of Artificial Sequence: Synthetic peptide
  XENP019532 vlCDR3
QQYGSSPWT

SEQ ID NO: 10095 - protein, 221 aa, Artificial Sequence
  Description of Artificial Sequence: Synthetic polypeptide
  XENP019544 [CTLA-4]_H1_L0_Fab Heavy Chain
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10096 - protein, 118 aa, Artificial Sequence; identical to SEQ ID NO: 4797
  Description of Artificial Sequence: Synthetic polypeptide
  VH of XENP019544

SEQ ID NO: 10097 - protein, 5 aa, Artificial Sequence
  Description of Artificial Sequence: Synthetic peptide
  XENP019544 vhCDR1
SYTMH

SEQ ID NO: 10098 - protein, 17 aa, Artificial Sequence
  Description of Artificial Sequence: Synthetic peptide
  XENP019544 vhCDR2
FISYDGNNKYYVDSVKG

SEQ ID NO: 10099 - protein, 9 aa, Artificial Sequence
  Description of Artificial Sequence: Synthetic peptide
  XENP019544 vhCDR3
TGWLGPFDY

SEQ ID NO: 10100 - protein, 215 aa, Artificial Sequence; identical to SEQ ID NO: 7600
  Description of Artificial Sequence: Synthetic polypeptide
  XENP019544 [CTLA-4]_H1_L0_Fab Light Chain

SEQ ID NO: 10101 - protein, 108 aa, Artificial Sequence; identical to SEQ ID NO: 3741
  Description of Artificial Sequence: Synthetic polypeptide
  VL of XENP019544

SEQ ID NO: 10102 - protein, 12 aa, Artificial Sequence
  Description of Artificial Sequence: Synthetic peptide
  XENP019544 vlCDR1
RASQSVGSSYLA

SEQ ID NO: 10103 - protein, 7 aa, Artificial Sequence
  Description of Artificial Sequence: Synthetic peptide
  XENP019544 vlCDR2
GAFSRAT

SEQ ID NO: 10104 - protein, 9 aa, Artificial Sequence
  Description of Artificial Sequence: Synthetic peptide
  XENP019544 vlCDR3
QQYGSSPWT

SEQ ID NO: 10105 - protein, 221 aa, Artificial Sequence
  Description of Artificial Sequence: Synthetic polypeptide
  XENP019545 [CTLA-4]_H2_L0_Fab Heavy Chain
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10106 - protein, 118 aa, Artificial Sequence; identical to SEQ ID NO: 4806
  Description of Artificial Sequence: Synthetic polypeptide
  VH of XENP019545

SEQ ID NO: 10107 - protein, 5 aa, Artificial Sequence
  Description of Artificial Sequence: Synthetic peptide
  XENP019545 vhCDR1
SYTMH

SEQ ID NO: 10108 - protein, 17 aa, Artificial Sequence
  Description of Artificial Sequence: Synthetic peptide
  XENP019545 vhCDR2
FISYDGNNKYYPGSVKG

SEQ ID NO: 10109 - protein, 9 aa, Artificial Sequence
  Description of Artificial Sequence: Synthetic peptide
  XENP019545 vhCDR3
TGWLGPFDY

SEQ ID NO: 10110 - protein, 215 aa, Artificial Sequence; identical to SEQ ID NO: 7600
  Description of Artificial Sequence: Synthetic polypeptide
  XENP019545 [CTLA-4]_H2_L0_Fab Light Chain

SEQ ID NO: 10111 - protein, 108 aa, Artificial Sequence; identical to SEQ ID NO: 3741
  Description of Artificial Sequence: Synthetic polypeptide
  VL of XENP019545

SEQ ID NO: 10112 - protein, 12 aa, Artificial Sequence
  Description of Artificial Sequence: Synthetic peptide
  XENP019545 vlCDR1
RASQSVGSSYLA

SEQ ID NO: 10113 - protein, 7 aa, Artificial Sequence
  Description of Artificial Sequence: Synthetic peptide
  XENP019545 vlCDR2
GAFSRAT

SEQ ID NO: 10114 - protein, 9 aa, Artificial Sequence
  Description of Artificial Sequence: Synthetic peptide
  XENP019545 vlCDR3
QQYGSSPWT

SEQ ID NO: 10115 - protein, 221 aa, Artificial Sequence
  Description of Artificial Sequence: Synthetic polypeptide
  XENP019546 [CTLA-4]_H3_L0_Fab Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10116 - protein, 118 aa, Artificial Sequence; identical to SEQ ID NO: 2405
  Description of Artificial Sequence: Synthetic polypeptide
  VH of XENP019546

SEQ ID NO: 10117 - protein, 5 aa, Artificial Sequence
  Description of Artificial Sequence: Synthetic peptide
  XENP019546 vhCDR1
SYTMH

SEQ ID NO: 10118 - protein, 17 aa, Artificial Sequence
  Description of Artificial Sequence: Synthetic peptide
  XENP019546 vhCDR2
FISYDGNNKYYADSVKG

SEQ ID NO: 10119 - protein, 9 aa, Artificial Sequence
  Description of Artificial Sequence: Synthetic peptide
  XENP019546 vhCDR3
TGWLGPFDY

SEQ ID NO: 10120 - protein, 215 aa, Artificial Sequence; identical to SEQ ID NO: 7600
  Description of Artificial Sequence: Synthetic polypeptide
  XENP019546 [CTLA-4]_H3_L0_Fab Light Chain

SEQ ID NO: 10121 - protein, 108 aa, Artificial Sequence; identical to SEQ ID NO: 3741
  Description of Artificial Sequence: Synthetic polypeptide
  VL of XENP019546

SEQ ID NO: 10122 - protein, 12 aa, Artificial Sequence
  Description of Artificial Sequence: Synthetic peptide
  XENP019546 vlCDR1
RASQSVGSSYLA

SEQ ID NO: 10123 - protein, 7 aa, Artificial Sequence
  Description of Artificial Sequence: Synthetic peptide
  XENP019546 vlCDR2
GAFSRAT

SEQ ID NO: 10124 - protein, 9 aa, Artificial Sequence
  Description of Artificial Sequence: Synthetic peptide
  XENP019546 vlCDR3
QQYGSSPWT

SEQ ID NO: 10125 - protein, 221 aa, Artificial Sequence
  Description of Artificial Sequence: Synthetic polypeptide
  XENP019547 [CTLA-4]_H4_L0_Fab Heavy Chain
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10126 - protein, 118 aa, Artificial Sequence; identical to SEQ ID NO: 4824
  Description of Artificial Sequence: Synthetic polypeptide
  VH of XENP019547

SEQ ID NO: 10127 - protein, 5 aa, Artificial Sequence
  Description of Artificial Sequence: Synthetic peptide
  XENP019547 vhCDR1
SYTMH

SEQ ID NO: 10128 - protein, 17 aa, Artificial Sequence
  Description of Artificial Sequence: Synthetic peptide
  XENP019547 vhCDR2
FISYDGNNKYYADSVKG

SEQ ID NO: 10129 - protein, 9 aa, Artificial Sequence
  Description of Artificial Sequence: Synthetic peptide
  XENP019547 vhCDR3
TGWLGPFDY

SEQ ID NO: 10130 - protein, 215 aa, Artificial Sequence; identical to SEQ ID NO: 7600
  Description of Artificial Sequence: Synthetic polypeptide
  XENP019547 [CTLA-4]_H4_L0_Fab Light Chain

SEQ ID NO: 10131 - protein, 108 aa, Artificial Sequence; identical to SEQ ID NO: 3741
  Description of Artificial Sequence: Synthetic polypeptide
  VL of XENP019547

SEQ ID NO: 10132 - protein, 12 aa, Artificial Sequence
  Description of Artificial Sequence: Synthetic peptide
  XENP019547 vlCDR1
RASQSVGSSYLA

SEQ ID NO: 10133 - protein, 7 aa, Artificial Sequence
  Description of Artificial Sequence: Synthetic peptide
  XENP019547 vlCDR2
GAFSRAT

SEQ ID NO: 10134 - protein, 9 aa, Artificial Sequence
  Description of Artificial Sequence: Synthetic peptide
  XENP019547 vlCDR3
QQYGSSPWT

SEQ ID NO: 10135 - protein, 221 aa, Artificial Sequence; identical to SEQ ID NO: 7595
  Description of Artificial Sequence: Synthetic polypeptide
  XENP019548 [CTLA-4]_H0_L1_Fab Heavy Chain

SEQ ID NO: 10136 - protein, 118 aa, Artificial Sequence; identical to SEQ ID NO: 3737
  Description of Artificial Sequence: Synthetic polypeptide
  VH of XENP019548

SEQ ID NO: 10137 - protein, 5 aa, Artificial Sequence
  Description of Artificial Sequence: Synthetic peptide
  XENP019548 vhCDR1
SYTMH

SEQ ID NO: 10138 - protein, 17 aa, Artificial Sequence
  Description of Artificial Sequence: Synthetic peptide
  XENP019548 vhCDR2
FISYDGNNKYYADSVKG

SEQ ID NO: 10139 - protein, 9 aa, Artificial Sequence
  Description of Artificial Sequence: Synthetic peptide
  XENP019548 vhCDR3
TGWLGPFDY

SEQ ID NO: 10140 - protein, 215 aa, Artificial Sequence
  Description of Artificial Sequence: Synthetic polypeptide
  XENP019548 [CTLA-4]_H0_L1_Fab Light Chain
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10141 - protein, 108 aa, Artificial Sequence; identical to SEQ ID NO: 4834
  Description of Artificial Sequence: Synthetic polypeptide
  VL of XENP019548

SEQ ID NO: 10142 - protein, 12 aa, Artificial Sequence
  Description of Artificial Sequence: Synthetic peptide
  XENP019548 vlCDR1
GASQSVGSSYLA

SEQ ID NO: 10143 - protein, 7 aa, Artificial Sequence
  Description of Artificial Sequence: Synthetic peptide
  XENP019548 vlCDR2
GAFSRAT

SEQ ID NO: 10144 - protein, 9 aa, Artificial Sequence
  Description of Artificial Sequence: Synthetic peptide
  XENP019548 vlCDR3
QQYGSSPWT

SEQ ID NO: 10145 - protein, 221 aa, Artificial Sequence; identical to SEQ ID NO: 7595
  Description of Artificial Sequence: Synthetic polypeptide
  XENP019549 [CTLA-4]_H0_L2_Fab Heavy Chain

SEQ ID NO: 10146 - protein, 118 aa, Artificial Sequence; identical to SEQ ID NO: 3737
  Description of Artificial Sequence: Synthetic polypeptide
  VH of XENP019549

SEQ ID NO: 10147 - protein, 5 aa, Artificial Sequence
  Description of Artificial Sequence: Synthetic peptide
  XENP019549 vhCDR1
SYTMH

SEQ ID NO: 10148 - protein, 17 aa, Artificial Sequence
  Description of Artificial Sequence: Synthetic peptide
  XENP019549 vhCDR2
FISYDGNNKYYADSVKG

SEQ ID NO: 10149 - protein, 9 aa, Artificial Sequence
  Description of Artificial Sequence: Synthetic peptide
  XENP019549 vhCDR3
TGWLGPFDY

SEQ ID NO: 10150 - protein, 215 aa, Artificial Sequence
  Description of Artificial Sequence: Synthetic polypeptide
  XENP019549 [CTLA-4]_H0_L2_Fab Light Chain
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10151 - protein, 108 aa, Artificial Sequence; identical to SEQ ID NO: 4843
  Description of Artificial Sequence: Synthetic polypeptide
  VL of XENP019549

SEQ ID NO: 10152 - protein, 12 aa, Artificial Sequence
  Description of Artificial Sequence: Synthetic peptide
  XENP019549 vlCDR1
RASQSVGSSYLA

SEQ ID NO: 10153 - protein, 7 aa, Artificial Sequence
  Description of Artificial Sequence: Synthetic peptide
  XENP019549 vlCDR2
GAFSRAT

SEQ ID NO: 10154 - protein, 9 aa, Artificial Sequence
  Description of Artificial Sequence: Synthetic peptide
  XENP019549 vlCDR3
QQYGSSPWT

SEQ ID NO: 10155 - protein, 221 aa, Artificial Sequence
  Description of Artificial Sequence: Synthetic polypeptide
  XENP019585 [CTLA-4]_H0.140_L0_Fab Heavy Chain
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10156 - protein, 118 aa, Artificial Sequence; identical to SEQ ID NO: 4851
  Description of Artificial Sequence: Synthetic polypeptide
  VH of XENP019585

SEQ ID NO: 10157 - protein, 5 aa, Artificial Sequence
  Description of Artificial Sequence: Synthetic peptide
  XENP019585 vhCDR1
SYTMH

SEQ ID NO: 10158 - protein, 17 aa, Artificial Sequence
  Description of Artificial Sequence: Synthetic peptide
  XENP019585 vhCDR2
FISYDGNNKYYADSVKG

SEQ ID NO: 10159 - protein, 9 aa, Artificial Sequence
  Description of Artificial Sequence: Synthetic peptide
  XENP019585 vhCDR3
TGWLGPFDY

SEQ ID NO: 10160 - protein, 215 aa, Artificial Sequence; identical to SEQ ID NO: 7600
  Description of Artificial Sequence: Synthetic polypeptide
  XENP019585 [CTLA-4]_H0.140_L0_Fab Light Chain

SEQ ID NO: 10161 - protein, 108 aa, Artificial Sequence; identical to SEQ ID NO: 3741
  Description of Artificial Sequence: Synthetic polypeptide
  VL of XENP019585

SEQ ID NO: 10162 - protein, 12 aa, Artificial Sequence
  Description of Artificial Sequence: Synthetic peptide
  XENP019585 vlCDR1
RASQSVGSSYLA

SEQ ID NO: 10163 - protein, 7 aa, Artificial Sequence
  Description of Artificial Sequence: Synthetic peptide
  XENP019585 vlCDR2
GAFSRAT

SEQ ID NO: 10164 - protein, 9 aa, Artificial Sequence
  Description of Artificial Sequence: Synthetic peptide
  XENP019585 vlCDR3
QQYGSSPWT

SEQ ID NO: 10165 - protein, 221 aa, Artificial Sequence; identical to SEQ ID NO: 7595
  Description of Artificial Sequence: Synthetic polypeptide
  XENP019586 [CTLA-4]_H0_L0.117_Fab Heavy Chain

SEQ ID NO: 10166 - protein, 118 aa, Artificial Sequence; identical to SEQ ID NO: 3737
  Description of Artificial Sequence: Synthetic polypeptide
  VH of XENP019586

SEQ ID NO: 10167 - protein, 5 aa, Artificial Sequence
  Description of Artificial Sequence: Synthetic peptide
  XENP019586 vhCDR1
SYTMH

SEQ ID NO: 10168 - protein, 17 aa, Artificial Sequence
  Description of Artificial Sequence: Synthetic peptide
  XENP019586 vhCDR2
FISYDGNNKYYADSVKG

SEQ ID NO: 10169 - protein, 9 aa, Artificial Sequence
  Description of Artificial Sequence: Synthetic peptide
  XENP019586 vhCDR3
TGWLGPFDY

SEQ ID NO: 10170 - protein, 215 aa, Artificial Sequence
  Description of Artificial Sequence: Synthetic polypeptide
  XENP019586 [CTLA-4]_H0_L0.117_Fab Light Chain
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10171 - protein, 108 aa, Artificial Sequence; identical to SEQ ID NO: 4861
  Description of Artificial Sequence: Synthetic polypeptide
  VL of XENP019586

SEQ ID NO: 10172 - protein, 12 aa, Artificial Sequence
  Description of Artificial Sequence: Synthetic peptide
  XENP019586 vlCDR1
RASQSVGSSYLA

SEQ ID NO: 10173 - protein, 7 aa, Artificial Sequence
  Description of Artificial Sequence: Synthetic peptide
  XENP019586 vlCDR2
GAFSRAT

SEQ ID NO: 10174 - protein, 9 aa, Artificial Sequence
  Description of Artificial Sequence: Synthetic peptide
  XENP019586 vlCDR3
QQYGSSPWT

SEQ ID NO: 10175 - protein, 221 aa, Artificial Sequence; identical to SEQ ID NO: 8935
  Description of Artificial Sequence: Synthetic polypeptide
  XENP020006 [CTLA-4]_H0.134_L0.53_Fab Heavy Chain

SEQ ID NO: 10176 - protein, 118 aa, Artificial Sequence; identical to SEQ ID NO: 4743
  Description of Artificial Sequence: Synthetic polypeptide
  VH of XENP020006

SEQ ID NO: 10177 - protein, 5 aa, Artificial Sequence
  Description of Artificial Sequence: Synthetic peptide
  XENP020006 vhCDR1
SYTMH

SEQ ID NO: 10178 - protein, 17 aa, Artificial Sequence
  Description of Artificial Sequence: Synthetic peptide
  XENP020006 vhCDR2
FISYDGNNKYYADSVKG

SEQ ID NO: 10179 - protein, 9 aa, Artificial Sequence
  Description of Artificial Sequence: Synthetic peptide
  XENP020006 vhCDR3
TGWLGPFDY

SEQ ID NO: 10180 - protein, 215 aa, Artificial Sequence; identical to SEQ ID NO: 9490
  Description of Artificial Sequence: Synthetic polypeptide
  XENP020006 [CTLA-4]_H0.134_L0.53_Fab Light Chain

SEQ ID NO: 10181 - protein, 108 aa, Artificial Sequence; identical to SEQ ID NO: 4753
  Description of Artificial Sequence: Synthetic polypeptide
  VL of XENP020006

SEQ ID NO: 10182 - protein, 12 aa, Artificial Sequence
  Description of Artificial Sequence: Synthetic peptide
  XENP020006 vlCDR1
RASQSVGSSYLA

SEQ ID NO: 10183 - protein, 7 aa, Artificial Sequence
  Description of Artificial Sequence: Synthetic peptide
  XENP020006 vlCDR2
GAFSRAT

SEQ ID NO: 10184 - protein, 9 aa, Artificial Sequence
  Description of Artificial Sequence: Synthetic peptide
  XENP020006 vlCDR3
QQYGSSPWT

SEQ ID NO: 10185 - protein, 221 aa, Artificial Sequence; identical to SEQ ID NO: 10115
  Description of Artificial Sequence: Synthetic polypeptide
  XENP020007 [CTLA-4]_H3_L1_Fab Heavy Chain

SEQ ID NO: 10186 - protein, 118 aa, Artificial Sequence; identical to SEQ ID NO: 2405
  Description of Artificial Sequence: Synthetic polypeptide
  VH of XENP020007

SEQ ID NO: 10187 - protein, 5 aa, Artificial Sequence
  Description of Artificial Sequence: Synthetic peptide
  XENP020007 vhCDR1
SYTMH

SEQ ID NO: 10188 - protein, 17 aa, Artificial Sequence
  Description of Artificial Sequence: Synthetic peptide
  XENP020007 vhCDR2
FISYDGNNKYYADSVKG

SEQ ID NO: 10189 - protein, 9 aa, Artificial Sequence
  Description of Artificial Sequence: Synthetic peptide
  XENP020007 vhCDR3
TGWLGPFDY

SEQ ID NO: 10190 - protein, 215 aa, Artificial Sequence; identical to SEQ ID NO: 10140
  Description of Artificial Sequence: Synthetic polypeptide
  XENP020007 [CTLA-4]_H3_L1_Fab Light Chain

SEQ ID NO: 10191 - protein, 108 aa, Artificial Sequence; identical to SEQ ID NO: 4834
  Description of Artificial Sequence: Synthetic polypeptide
  VL of XENP020007

SEQ ID NO: 10192 - protein, 12 aa, Artificial Sequence
  Description of Artificial Sequence: Synthetic peptide
  XENP020007 vlCDR1
GASQSVGSSYLA

SEQ ID NO: 10193 - protein, 7 aa, Artificial Sequence
  Description of Artificial Sequence: Synthetic peptide
  XENP020007 vlCDR2
GAFSRAT

SEQ ID NO: 10194 - protein, 9 aa, Artificial Sequence
  Description of Artificial Sequence: Synthetic peptide
  XENP020007 vlCDR3
QQYGSSPWT

SEQ ID NO: 10195 - protein, 221 aa, Artificial Sequence; identical to SEQ ID NO: 10115
  Description of Artificial Sequence: Synthetic polypeptide
  XENP020008 [CTLA-4]_H3_L2_Fab Heavy Chain

SEQ ID NO: 10196 - protein, 118 aa, Artificial Sequence; identical to SEQ ID NO: 2405
  Description of Artificial Sequence: Synthetic polypeptide
  VH of XENP020008

SEQ ID NO: 10197 - protein, 5 aa, Artificial Sequence
  Description of Artificial Sequence: Synthetic peptide
  XENP020008 vhCDR1
SYTMH

SEQ ID NO: 10198 - protein, 17 aa, Artificial Sequence
  Description of Artificial Sequence: Synthetic peptide
  XENP020008 vhCDR2
FISYDGNNKYYADSVKG

SEQ ID NO: 10199 - protein, 9 aa, Artificial Sequence
  Description of Artificial Sequence: Synthetic peptide
  XENP020008 vhCDR3
TGWLGPFDY

SEQ ID NO: 10200 - protein, 215 aa, Artificial Sequence; identical to SEQ ID NO: 10150
  Description of Artificial Sequence: Synthetic polypeptide
  XENP020008 [CTLA-4]_H3_L2_Fab Light Chain

SEQ ID NO: 10201 - protein, 108 aa, Artificial Sequence; identical to SEQ ID NO: 4843
  Description of Artificial Sequence: Synthetic polypeptide
  VL of XENP020008

SEQ ID NO: 10202 - protein, 12 aa, Artificial Sequence
  Description of Artificial Sequence: Synthetic peptide
  XENP020008 vlCDR1
RASQSVGSSYLA

SEQ ID NO: 10203 - protein, 7 aa, Artificial Sequence
  Description of Artificial Sequence: Synthetic peptide
  XENP020008 vlCDR2
GAFSRAT

SEQ ID NO: 10204 - protein, 9 aa, Artificial Sequence
  Description of Artificial Sequence: Synthetic peptide
  XENP020008 vlCDR3
QQYGSSPWT

SEQ ID NO: 10205 - protein, 221 aa, Artificial Sequence; identical to SEQ ID NO: 10115
  Description of Artificial Sequence: Synthetic polypeptide
  XENP020009 [CTLA-4]_H3_L0.12_Fab Heavy Chain

SEQ ID NO: 10206 - protein, 118 aa, Artificial Sequence; identical to SEQ ID NO: 2405
  Description of Artificial Sequence: Synthetic polypeptide
  VH of XENP020009

SEQ ID NO: 10207 - protein, 5 aa, Artificial Sequence
  Description of Artificial Sequence: Synthetic peptide
  XENP020009 vhCDR1
SYTMH

SEQ ID NO: 10208 - protein, 17 aa, Artificial Sequence
  Description of Artificial Sequence: Synthetic peptide
  XENP020009 vhCDR2
FISYDGNNKYYADSVKG

SEQ ID NO: 10209 - protein, 9 aa, Artificial Sequence
  Description of Artificial Sequence: Synthetic peptide
  XENP020009 vhCDR3
TGWLGPFDY

SEQ ID NO: 10210 - protein, 215 aa, Artificial Sequence; identical to SEQ ID NO: 9080
  Description of Artificial Sequence: Synthetic polypeptide
  XENP020009 [CTLA-4]_H3_L0.12_Fab Light Chain

SEQ ID NO: 10211 - protein, 108 aa, Artificial Sequence; identical to SEQ ID NO: 6193
  Description of Artificial Sequence: Synthetic polypeptide
  VL of XENP020009

SEQ ID NO: 10212 - protein, 12 aa, Artificial Sequence
  Description of Artificial Sequence: Synthetic peptide
  XENP020009 vlCDR1
RASQSVGSSYLA

SEQ ID NO: 10213 - protein, 7 aa, Artificial Sequence
  Description of Artificial Sequence: Synthetic peptide
  XENP020009 vlCDR2
GAFSRAT

SEQ ID NO: 10214 - protein, 9 aa, Artificial Sequence
  Description of Artificial Sequence: Synthetic peptide
  XENP020009 vlCDR3
QQYGSSPWT

SEQ ID NO: 10215 - protein, 221 aa, Artificial Sequence; identical to SEQ ID NO: 10115
  Description of Artificial Sequence: Synthetic polypeptide
  XENP020010 [CTLA-4]_H3_L0.18_Fab Heavy Chain

SEQ ID NO: 10216 - protein, 118 aa, Artificial Sequence; identical to SEQ ID NO: 2405
  Description of Artificial Sequence: Synthetic polypeptide
  VH of XENP020010

SEQ ID NO: 10217 - protein, 5 aa, Artificial Sequence
  Description of Artificial Sequence: Synthetic peptide
  XENP020010 vhCDR1
SYTMH

SEQ ID NO: 10218 - protein, 17 aa, Artificial Sequence
  Description of Artificial Sequence: Synthetic peptide
  XENP020010 vhCDR2
FISYDGNNKYYADSVKG

SEQ ID NO: 10219 - protein, 9 aa, Artificial Sequence
  Description of Artificial Sequence: Synthetic peptide
  XENP020010 vhCDR3
TGWLGPFDY

SEQ ID NO: 10220 - protein, 215 aa, Artificial Sequence; identical to SEQ ID NO: 9140
  Description of Artificial Sequence: Synthetic polypeptide
  XENP020010 [CTLA-4]_H3_L0.18_Fab Light Chain

SEQ ID NO: 10221 - protein, 108 aa, Artificial Sequence; identical to SEQ ID NO: 6247
  Description of Artificial Sequence: Synthetic polypeptide
  VL of XENP020010

SEQ ID NO: 10222 - protein, 12 aa, Artificial Sequence
  Description of Artificial Sequence: Synthetic peptide
  XENP020010 vlCDR1
RSSQSVGSSYLA

SEQ ID NO: 10223 - protein, 7 aa, Artificial Sequence
  Description of Artificial Sequence: Synthetic peptide
  XENP020010 vlCDR2
GAFSRAT

SEQ ID NO: 10224 - protein, 9 aa, Artificial Sequence
  Description of Artificial Sequence: Synthetic peptide
  XENP020010 vlCDR3
QQYGSSPWT

SEQ ID NO: 10225 - protein, 221 aa, Artificial Sequence; identical to SEQ ID NO: 10115
  Description of Artificial Sequence: Synthetic polypeptide
  XENP020011 [CTLA-4]_H3_L0.22_Fab Heavy Chain

SEQ ID NO: 10226 - protein, 118 aa, Artificial Sequence; identical to SEQ ID NO: 2405
  Description of Artificial Sequence: Synthetic polypeptide
  VH of XENP020011

SEQ ID NO: 10227 - protein, 5 aa, Artificial Sequence
  Description of Artificial Sequence: Synthetic peptide
  XENP020011 vhCDR1
SYTMH

SEQ ID NO: 10228 - protein, 17 aa, Artificial Sequence
  Description of Artificial Sequence: Synthetic peptide
  XENP020011 vhCDR2
FISYDGNNKYYADSVKG

SEQ ID NO: 10229 - protein, 9 aa, Artificial Sequence
  Description of Artificial Sequence: Synthetic peptide
  XENP020011 vhCDR3
TGWLGPFDY

SEQ ID NO: 10230 - protein, 215 aa, Artificial Sequence; identical to SEQ ID NO: 2410
  Description of Artificial Sequence: Synthetic polypeptide
  XENP020011 [CTLA-4]_H3_L0.22_Fab Light Chain

SEQ ID NO: 10231 - protein, 108 aa, Artificial Sequence; identical to SEQ ID NO: 2411
  Description of Artificial Sequence: Synthetic polypeptide
  VL of XENP020011

SEQ ID NO: 10232 - protein, 12 aa, Artificial Sequence
  Description of Artificial Sequence: Synthetic peptide
  XENP020011 vlCDR1
RASQSVSSSYLA

SEQ ID NO: 10233 - protein, 7 aa, Artificial Sequence
  Description of Artificial Sequence: Synthetic peptide
  XENP020011 vlCDR2
GAFSRAT

SEQ ID NO: 10234 - protein, 9 aa, Artificial Sequence
  Description of Artificial Sequence: Synthetic peptide
  XENP020011 vlCDR3
QQYGSSPWT

SEQ ID NO: 10235 - protein, 221 aa, Artificial Sequence; identical to SEQ ID NO: 10115
  Description of Artificial Sequence: Synthetic polypeptide
  XENP020012 [CTLA-4]_H3_L0.27_Fab Heavy Chain

SEQ ID NO: 10236 - protein, 118 aa, Artificial Sequence; identical to SEQ ID NO: 2405
  Description of Artificial Sequence: Synthetic polypeptide
  VH of XENP020012

SEQ ID NO: 10237 - protein, 5 aa, Artificial Sequence
  Description of Artificial Sequence: Synthetic peptide
  XENP020012 vhCDR1
SYTMH

SEQ ID NO: 10238 - protein, 17 aa, Artificial Sequence
  Description of Artificial Sequence: Synthetic peptide
  XENP020012 vhCDR2
FISYDGNNKYYADSVKG

SEQ ID NO: 10239 - protein, 9 aa, Artificial Sequence
  Description of Artificial Sequence: Synthetic peptide
  XENP020012 vhCDR3
TGWLGPFDY

SEQ ID NO: 10240 - protein, 215 aa, Artificial Sequence; identical to SEQ ID NO: 9230
  Description of Artificial Sequence: Synthetic polypeptide
  XENP020012 [CTLA-4]_H3_L0.27_Fab Light Chain

SEQ ID NO: 10241 - protein, 108 aa, Artificial Sequence; identical to SEQ ID NO: 6328
  Description of Artificial Sequence: Synthetic polypeptide
  VL of XENP020012

SEQ ID NO: 10242 - protein, 12 aa, Artificial Sequence
  Description of Artificial Sequence: Synthetic peptide
  XENP020012 vlCDR1
RASQSVGQSYLA

SEQ ID NO: 10243 - protein, 7 aa, Artificial Sequence
  Description of Artificial Sequence: Synthetic peptide
  XENP020012 vlCDR2
GAFSRAT

SEQ ID NO: 10244 - protein, 9 aa, Artificial Sequence
  Description of Artificial Sequence: Synthetic peptide
  XENP020012 vlCDR3
QQYGSSPWT

SEQ ID NO: 10245 - protein, 221 aa, Artificial Sequence; identical to SEQ ID NO: 10115
  Description of Artificial Sequence: Synthetic polypeptide
  XENP020013 [CTLA-4]_H3_L0.32_Fab Heavy Chain

SEQ ID NO: 10246 - protein, 118 aa, Artificial Sequence; identical to SEQ ID NO: 2405
  Description of Artificial Sequence: Synthetic polypeptide
  VH of XENP020013

SEQ ID NO: 10247 - protein, 5 aa, Artificial Sequence
  Description of Artificial Sequence: Synthetic peptide
  XENP020013 vhCDR1
SYTMH

SEQ ID NO: 10248 - protein, 17 aa, Artificial Sequence
  Description of Artificial Sequence: Synthetic peptide
  XENP020013 vhCDR2
FISYDGNNKYYADSVKG

SEQ ID NO: 10249 - protein, 9 aa, Artificial Sequence
  Description of Artificial Sequence: Synthetic peptide
  XENP020013 vhCDR3
TGWLGPFDY

SEQ ID NO: 10250 - protein, 215 aa, Artificial Sequence; identical to SEQ ID NO: 9280
  Description of Artificial Sequence: Synthetic polypeptide
  XENP020013 [CTLA-4]_H3_L0.32_Fab Light Chain

SEQ ID NO: 10251 - protein, 108 aa, Artificial Sequence; identical to SEQ ID NO: 6373
  Description of Artificial Sequence: Synthetic polypeptide
  VL of XENP020013

SEQ ID NO: 10252 - protein, 12 aa, Artificial Sequence
  Description of Artificial Sequence: Synthetic peptide
  XENP020013 vlCDR1
RASQSVGSQYLA

SEQ ID NO: 10253 - protein, 7 aa, Artificial Sequence
  Description of Artificial Sequence: Synthetic peptide
  XENP020013 vlCDR2
GAFSRAT

SEQ ID NO: 10254 - protein, 9 aa, Artificial Sequence
  Description of Artificial Sequence: Synthetic peptide
  XENP020013 vlCDR3
QQYGSSPWT

SEQ ID NO: 10255 - protein, 221 aa, Artificial Sequence; identical to SEQ ID NO: 10115
  Description of Artificial Sequence: Synthetic polypeptide
  XENP020014 [CTLA-4]_H3_L0.36_Fab Heavy Chain

SEQ ID NO: 10256 - protein, 118 aa, Artificial Sequence; identical to SEQ ID NO: 2405
  Description of Artificial Sequence: Synthetic polypeptide
  VH of XENP020014

SEQ ID NO: 10257 - protein, 5 aa, Artificial Sequence
  Description of Artificial Sequence: Synthetic peptide
  XENP020014 vhCDR1
SYTMH

SEQ ID NO: 10258 - protein, 17 aa, Artificial Sequence
  Description of Artificial Sequence: Synthetic peptide
  XENP020014 vhCDR2
FISYDGNNKYYADSVKG

SEQ ID NO: 10259 - protein, 9 aa, Artificial Sequence
  Description of Artificial Sequence: Synthetic peptide
  XENP020014 vhCDR3
TGWLGPFDY

SEQ ID NO: 10260 - protein, 215 aa, Artificial Sequence; identical to SEQ ID NO: 9320
  Description of Artificial Sequence: Synthetic polypeptide
  XENP020014 [CTLA-4]_H3_L0.36_Fab Light Chain

SEQ ID NO: 10261 - protein, 108 aa, Artificial Sequence; identical to SEQ ID NO: 6409
  Description of Artificial Sequence: Synthetic polypeptide
  VL of XENP020014

SEQ ID NO: 10262 - protein, 12 aa, Artificial Sequence
  Description of Artificial Sequence: Synthetic peptide
  XENP020014 vlCDR1
RASQSVGSSHLA

SEQ ID NO: 10263 - protein, 7 aa, Artificial Sequence
  Description of Artificial Sequence: Synthetic peptide
  XENP020014 vlCDR2
GAFSRAT

SEQ ID NO: 10264 - protein, 9 aa, Artificial Sequence
  Description of Artificial Sequence: Synthetic peptide
  XENP020014 vlCDR3
QQYGSSPWT

SEQ ID NO: 10265 - protein, 221 aa, Artificial Sequence; identical to SEQ ID NO: 10115
  Description of Artificial Sequence: Synthetic polypeptide
  XENP020015 [CTLA-4]_H3_L0.37_Fab Heavy Chain

SEQ ID NO: 10266 - protein, 118 aa, Artificial Sequence; identical to SEQ ID NO: 2405
  Description of Artificial Sequence: Synthetic polypeptide
  VH of XENP020015

SEQ ID NO: 10267 - protein, 5 aa, Artificial Sequence
  Description of Artificial Sequence: Synthetic peptide
  XENP020015 vhCDR1
SYTMH

SEQ ID NO: 10268 - protein, 17 aa, Artificial Sequence
  Description of Artificial Sequence: Synthetic peptide
  XENP020015 vhCDR2
FISYDGNNKYYADSVKG

SEQ ID NO: 10269 - protein, 9 aa, Artificial Sequence
  Description of Artificial Sequence: Synthetic peptide
  XENP020015 vhCDR3
TGWLGPFDY

SEQ ID NO: 10270 - protein, 215 aa, Artificial Sequence; identical to SEQ ID NO: 9330
  Description of Artificial Sequence: Synthetic polypeptide
  XENP020015 [CTLA-4]_H3_L0.37_Fab Light Chain

SEQ ID NO: 10271 - protein, 108 aa, Artificial Sequence; identical to SEQ ID NO: 6418
  Description of Artificial Sequence: Synthetic polypeptide
  VL of XENP020015

SEQ ID NO: 10272 - protein, 12 aa, Artificial Sequence
  Description of Artificial Sequence: Synthetic peptide
  XENP020015 vlCDR1
RASQSVGSSLLA

SEQ ID NO: 10273 - protein, 7 aa, Artificial Sequence
  Description of Artificial Sequence: Synthetic peptide
  XENP020015 vlCDR2
GAFSRAT

SEQ ID NO: 10274 - protein, 9 aa, Artificial Sequence
  Description of Artificial Sequence: Synthetic peptide
  XENP020015 vlCDR3
QQYGSSPWT

SEQ ID NO: 10275 - protein, 221 aa, Artificial Sequence; identical to SEQ ID NO: 10115
  Description of Artificial Sequence: Synthetic polypeptide
  XENP020016 [CTLA-4]_H3_L0.39_Fab Heavy Chain

SEQ ID NO: 10276 - protein, 118 aa, Artificial Sequence; identical to SEQ ID NO: 2405
  Description of Artificial Sequence: Synthetic polypeptide
  VH of XENP020016

SEQ ID NO: 10277 - protein, 5 aa, Artificial Sequence
  Description of Artificial Sequence: Synthetic peptide
  XENP020016 vhCDR1
SYTMH

SEQ ID NO: 10278 - protein, 17 aa, Artificial Sequence
  Description of Artificial Sequence: Synthetic peptide
  XENP020016 vhCDR2
FISYDGNNKYYADSVKG

SEQ ID NO: 10279 - protein, 9 aa, Artificial Sequence
  Description of Artificial Sequence: Synthetic peptide
  XENP020016 vhCDR3
TGWLGPFDY

SEQ ID NO: 10280 - protein, 215 aa, Artificial Sequence; identical to SEQ ID NO: 9350
  Description of Artificial Sequence: Synthetic polypeptide
  XENP020016 [CTLA-4]_H3_L0.39_Fab Light Chain

SEQ ID NO: 10281 - protein, 108 aa, Artificial Sequence; identical to SEQ ID NO: 6436
  Description of Artificial Sequence: Synthetic polypeptide
  VL of XENP020016

SEQ ID NO: 10282 - protein, 12 aa, Artificial Sequence
  Description of Artificial Sequence: Synthetic peptide
  XENP020016 vlCDR1
RASQSVGSSSLA

SEQ ID NO: 10283 - protein, 7 aa, Artificial Sequence
  Description of Artificial Sequence: Synthetic peptide
  XENP020016 vlCDR2
GAFSRAT

SEQ ID NO: 10284 - protein, 9 aa, Artificial Sequence
  Description of Artificial Sequence: Synthetic peptide
  XENP020016 vlCDR3
QQYGSSPWT

SEQ ID NO: 10285 - protein, 221 aa, Artificial Sequence; identical to SEQ ID NO: 10115
  Description of Artificial Sequence: Synthetic polypeptide
  XENP020017 [CTLA-4]_H3_L0.41_Fab Heavy Chain

SEQ ID NO: 10286 - protein, 118 aa, Artificial Sequence; identical to SEQ ID NO: 2405
  Description of Artificial Sequence: Synthetic polypeptide
  VH of XENP020017

SEQ ID NO: 10287 - protein, 5 aa, Artificial Sequence
  Description of Artificial Sequence: Synthetic peptide
  XENP020017 vhCDR1
SYTMH

SEQ ID NO: 10288 - protein, 17 aa, Artificial Sequence
  Description of Artificial Sequence: Synthetic peptide
  XENP020017 vhCDR2
FISYDGNNKYYADSVKG

SEQ ID NO: 10289 - protein, 9 aa, Artificial Sequence
  Description of Artificial Sequence: Synthetic peptide
  XENP020017 vhCDR3
TGWLGPFDY

SEQ ID NO: 10290 - protein, 215 aa, Artificial Sequence; identical to SEQ ID NO: 9370
  Description of Artificial Sequence: Synthetic polypeptide
  XENP020017 [CTLA-4]_H3_L0.41_Fab Light Chain

SEQ ID NO: 10291 - protein, 108 aa, Artificial Sequence; identical to SEQ ID NO: 6454
  Description of Artificial Sequence: Synthetic polypeptide
  VL of XENP020017

SEQ ID NO: 10292 - protein, 12 aa, Artificial Sequence
  Description of Artificial Sequence: Synthetic peptide
  XENP020017 vlCDR1
RASQSVGSSYMA

SEQ ID NO: 10293 - protein, 7 aa, Artificial Sequence
  Description of Artificial Sequence: Synthetic peptide
  XENP020017 vlCDR2
GAFSRAT

SEQ ID NO: 10294 - protein, 9 aa, Artificial Sequence
  Description of Artificial Sequence: Synthetic peptide
  XENP020017 vlCDR3
QQYGSSPWT

SEQ ID NO: 10295 - protein, 221 aa, Artificial Sequence; identical to SEQ ID NO: 10115
  Description of Artificial Sequence: Synthetic polypeptide
  XENP020018 [CTLA-4]_H3_L0.67_Fab Heavy Chain

SEQ ID NO: 10296 - protein, 118 aa, Artificial Sequence; identical to SEQ ID NO: 2405
  Description of Artificial Sequence: Synthetic polypeptide
  VH of XENP020018

SEQ ID NO: 10297 - protein, 5 aa, Artificial Sequence
  Description of Artificial Sequence: Synthetic peptide
  XENP020018 vhCDR1
SYTMH

SEQ ID NO: 10298 - protein, 17 aa, Artificial Sequence
  Description of Artificial Sequence: Synthetic peptide
  XENP020018 vhCDR2
FISYDGNNKYYADSVKG

SEQ ID NO: 10299 - protein, 9 aa, Artificial Sequence
  Description of Artificial Sequence: Synthetic peptide
  XENP020018 vhCDR3
TGWLGPFDY

SEQ ID NO: 10300 - protein, 215 aa, Artificial Sequence; identical to SEQ ID NO: 9630
  Description of Artificial Sequence: Synthetic polypeptide
  XENP020018 [CTLA-4]_H3_L0.67_Fab Light Chain

SEQ ID NO: 10301 - protein, 108 aa, Artificial Sequence; identical to SEQ ID NO: 6688
  Description of Artificial Sequence: Synthetic polypeptide
  VL of XENP020018

SEQ ID NO: 10302 - protein, 12 aa, Artificial Sequence
  Description of Artificial Sequence: Synthetic peptide
  XENP020018 vlCDR1
RASQSVGSSYLA

SEQ ID NO: 10303 - protein, 7 aa, Artificial Sequence
  Description of Artificial Sequence: Synthetic peptide
  XENP020018 vlCDR2
DAFSRAT

SEQ ID NO: 10304 - protein, 9 aa, Artificial Sequence
  Description of Artificial Sequence: Synthetic peptide
  XENP020018 vlCDR3
QQYGSSPWT

SEQ ID NO: 10305 - protein, 221 aa, Artificial Sequence; identical to SEQ ID NO: 10115
  Description of Artificial Sequence: Synthetic polypeptide
  XENP020019 [CTLA-4]_H3_L0.69_Fab Heavy Chain

SEQ ID NO: 10306 - protein, 118 aa, Artificial Sequence; identical to SEQ ID NO: 2405
  Description of Artificial Sequence: Synthetic polypeptide
  VH of XENP020019

SEQ ID NO: 10307 - protein, 5 aa, Artificial Sequence
  Description of Artificial Sequence: Synthetic peptide
  XENP020019 vhCDR1
SYTMH

SEQ ID NO: 10308 - protein, 17 aa, Artificial Sequence
  Description of Artificial Sequence: Synthetic peptide
  XENP020019 vhCDR2
FISYDGNNKYYADSVKG

SEQ ID NO: 10309 - protein, 9 aa, Artificial Sequence
  Description of Artificial Sequence: Synthetic peptide
  XENP020019 vhCDR3
TGWLGPFDY

SEQ ID NO: 10310 - protein, 215 aa, Artificial Sequence; identical to SEQ ID NO: 9650
  Description of Artificial Sequence: Synthetic polypeptide
  XENP020019 [CTLA-4]_H3_L0.69_Fab Light Chain

SEQ ID NO: 10311 - protein, 108 aa, Artificial Sequence; identical to SEQ ID NO: 6706
  Description of Artificial Sequence: Synthetic polypeptide
  VL of XENP020019

SEQ ID NO: 10312 - protein, 12 aa, Artificial Sequence
  Description of Artificial Sequence: Synthetic peptide
  XENP020019 vlCDR1
RASQSVGSSYLA

SEQ ID NO: 10313 - protein, 7 aa, Artificial Sequence
  Description of Artificial Sequence: Synthetic peptide
  XENP020019 vlCDR2
GVFSRAT

SEQ ID NO: 10314 - protein, 9 aa, Artificial Sequence
  Description of Artificial Sequence: Synthetic peptide
  XENP020019 vlCDR3
QQYGSSPWT

SEQ ID NO: 10315 - protein, 221 aa, Artificial Sequence; identical to SEQ ID NO: 10115
  Description of Artificial Sequence: Synthetic polypeptide
  XENP020020 [CTLA-4]_H3_L0.74_Fab Heavy Chain

SEQ ID NO: 10316 - protein, 118 aa, Artificial Sequence; identical to SEQ ID NO: 2405
  Description of Artificial Sequence: Synthetic polypeptide
  VH of XENP020020

SEQ ID NO: 10317 - protein, 5 aa, Artificial Sequence
  Description of Artificial Sequence: Synthetic peptide
  XENP020020 vhCDR1
SYTMH

SEQ ID NO: 10318 - protein, 17 aa, Artificial Sequence
  Description of Artificial Sequence: Synthetic peptide
  XENP020020 vhCDR2
FISYDGNNKYYADSVKG

SEQ ID NO: 10319 - protein, 9 aa, Artificial Sequence
  Description of Artificial Sequence: Synthetic peptide
  XENP020020 vhCDR3
TGWLGPFDY

SEQ ID NO: 10320 - protein, 215 aa, Artificial Sequence; identical to SEQ ID NO: 9700
  Description of Artificial Sequence: Synthetic polypeptide
  XENP020020 [CTLA-4]_H3_L0.74_Fab Light Chain

SEQ ID NO: 10321 - protein, 108 aa, Artificial Sequence; identical to SEQ ID NO: 6751
  Description of Artificial Sequence: Synthetic polypeptide
  VL of XENP020020

SEQ ID NO: 10322 - protein, 12 aa, Artificial Sequence
  Description of Artificial Sequence: Synthetic peptide
  XENP020020 vlCDR1
RASQSVGSSYLA

SEQ ID NO: 10323 - protein, 7 aa, Artificial Sequence
  Description of Artificial Sequence: Synthetic peptide
  XENP020020 vlCDR2
GAYSRAT

SEQ ID NO: 10324 - protein, 9 aa, Artificial Sequence
  Description of Artificial Sequence: Synthetic peptide
  XENP020020 vlCDR3
QQYGSSPWT

SEQ ID NO: 10325 - protein, 221 aa, Artificial Sequence; identical to SEQ ID NO: 10115
  Description of Artificial Sequence: Synthetic polypeptide
  XENP020021 [CTLA-4]_H3_L0.75_Fab Heavy Chain

SEQ ID NO: 10326 - protein, 118 aa, Artificial Sequence; identical to SEQ ID NO: 2405
  Description of Artificial Sequence: Synthetic polypeptide
  VH of XENP020021

SEQ ID NO: 10327 - protein, 5 aa, Artificial Sequence
  Description of Artificial Sequence: Synthetic peptide
  XENP020021 vhCDR1
SYTMH

SEQ ID NO: 10328 - protein, 17 aa, Artificial Sequence
  Description of Artificial Sequence: Synthetic peptide
  XENP020021 vhCDR2
FISYDGNNKYYADSVKG

SEQ ID NO: 10329 - protein, 9 aa, Artificial Sequence
  Description of Artificial Sequence: Synthetic peptide
  XENP020021 vhCDR3
TGWLGPFDY

SEQ ID NO: 10330 - protein, 215 aa, Artificial Sequence; identical to SEQ ID NO: 9710
  Description of Artificial Sequence: Synthetic polypeptide
  XENP020021 [CTLA-4]_H3_L0.75_Fab Light Chain

SEQ ID NO: 10331 - protein, 108 aa, Artificial Sequence; identical to SEQ ID NO: 6760
  Description of Artificial Sequence: Synthetic polypeptide
  VL of XENP020021

SEQ ID NO: 10332 - protein, 12 aa, Artificial Sequence
  Description of Artificial Sequence: Synthetic peptide
  XENP020021 vlCDR1
RASQSVGSSYLA

SEQ ID NO: 10333 - protein, 7 aa, Artificial Sequence
  Description of Artificial Sequence: Synthetic peptide
  XENP020021 vlCDR2
GAFARAT

SEQ ID NO: 10334 - protein, 9 aa, Artificial Sequence
  Description of Artificial Sequence: Synthetic peptide
  XENP020021 vlCDR3
QQYGSSPWT

SEQ ID NO: 10335 - protein, 221 aa, Artificial Sequence; identical to SEQ ID NO: 10115
  Description of Artificial Sequence: Synthetic polypeptide
  XENP020022 [CTLA-4]_H3_L0.103_Fab Heavy Chain

SEQ ID NO: 10336 - protein, 118 aa, Artificial Sequence; identical to SEQ ID NO: 2405
  Description of Artificial Sequence: Synthetic polypeptide
  VH of XENP020022

SEQ ID NO: 10337 - protein, 5 aa, Artificial Sequence
  Description of Artificial Sequence: Synthetic peptide
  XENP020022 vhCDR1
SYTMH

SEQ ID NO: 10338 - protein, 17 aa, Artificial Sequence
  Description of Artificial Sequence: Synthetic peptide
  XENP020022 vhCDR2
FISYDGNNKYYADSVKG

SEQ ID NO: 10339 - protein, 9 aa, Artificial Sequence
  Description of Artificial Sequence: Synthetic peptide
  XENP020022 vhCDR3
TGWLGPFDY

SEQ ID NO: 10340 - protein, 215 aa, Artificial Sequence; identical to SEQ ID NO: 9990
  Description of Artificial Sequence: Synthetic polypeptide
  XENP020022 [CTLA-4]_H3_L0.103_Fab Light Chain

SEQ ID NO: 10341 - protein, 108 aa, Artificial Sequence; identical to SEQ ID NO: 7012
  Description of Artificial Sequence: Synthetic polypeptide
  VL of XENP020022

SEQ ID NO: 10342 - protein, 12 aa, Artificial Sequence
  Description of Artificial Sequence: Synthetic peptide
  XENP020022 vlCDR1
RASQSVGSSYLA

SEQ ID NO: 10343 - protein, 7 aa, Artificial Sequence
  Description of Artificial Sequence: Synthetic peptide
  XENP020022 vlCDR2
GAFSRAT

SEQ ID NO: 10344 - protein, 9 aa, Artificial Sequence
  Description of Artificial Sequence: Synthetic peptide
  XENP020022 vlCDR3
QQYGKSPWT

SEQ ID NO: 10345 - protein, 221 aa, Artificial Sequence; identical to SEQ ID NO: 10115
  Description of Artificial Sequence: Synthetic polypeptide
  XENP020052 [CTLA-4]_H3_L0.44_Fab Heavy Chain

SEQ ID NO: 10346 - protein, 118 aa, Artificial Sequence; identical to SEQ ID NO: 2405
  Description of Artificial Sequence: Synthetic polypeptide
  VH of XENP020052

SEQ ID NO: 10347 - protein, 5 aa, Artificial Sequence
  Description of Artificial Sequence: Synthetic peptide
  XENP020052 vhCDR1
SYTMH

SEQ ID NO: 10348 - protein, 17 aa, Artificial Sequence
  Description of Artificial Sequence: Synthetic peptide
  XENP020052 vhCDR2
FISYDGNNKYYADSVKG

SEQ ID NO: 10349 - protein, 9 aa, Artificial Sequence
  Description of Artificial Sequence: Synthetic peptide
  XENP020052 vhCDR3
TGWLGPFDY

SEQ ID NO: 10350 - protein, 215 aa, Artificial Sequence; identical to SEQ ID NO: 9400
  Description of Artificial Sequence: Synthetic polypeptide
  XENP020052 [CTLA-4]_H3_L0.44_Fab Light Chain

SEQ ID NO: 10351 - protein, 108 aa, Artificial Sequence; identical to SEQ ID NO: 6481
  Description of Artificial Sequence: Synthetic polypeptide
  VL of XENP020052

SEQ ID NO: 10352 - protein, 12 aa, Artificial Sequence
  Description of Artificial Sequence: Synthetic peptide
  XENP020052 vlCDR1
RASQSVGSSYLS

SEQ ID NO: 10353 - protein, 7 aa, Artificial Sequence
  Description of Artificial Sequence: Synthetic peptide
  XENP020052 vlCDR2
GAFSRAT

SEQ ID NO: 10354 - protein, 9 aa, Artificial Sequence
  Description of Artificial Sequence: Synthetic peptide
  XENP020052 vlCDR3
QQYGSSPWT

SEQ ID NO: 10355 - protein, 221 aa, Artificial Sequence
  Description of Artificial Sequence: Synthetic polypeptide
  XENP020068 [CTLA-4]_H3.1_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10356 - protein, 118 aa, Artificial Sequence; identical to SEQ ID NO: 7110
  Description of Artificial Sequence: Synthetic polypeptide
  VH of XENP020068

SEQ ID NO: 10357 - protein, 5 aa, Artificial Sequence
  Description of Artificial Sequence: Synthetic peptide
  XENP020068 vhCDR1
SYTMH

SEQ ID NO: 10358 - protein, 17 aa, Artificial Sequence
  Description of Artificial Sequence: Synthetic peptide
  XENP020068 vhCDR2
FISYDGNHKYYADSVKG

SEQ ID NO: 10359 - protein, 9 aa, Artificial Sequence
  Description of Artificial Sequence: Synthetic peptide
  XENP020068 vhCDR3
TGLLGPFDL

SEQ ID NO: 10360 - protein, 215 aa, Artificial Sequence; identical to SEQ ID NO: 9080
  Description of Artificial Sequence: Synthetic polypeptide
  XENP020068 [CTLA-4]_H3.1_L0.12_Fab Light Chain

SEQ ID NO: 10361 - protein, 108 aa, Artificial Sequence; identical to SEQ ID NO: 6193
  Description of Artificial Sequence: Synthetic polypeptide
  VL of XENP020068

SEQ ID NO: 10362 - protein, 12 aa, Artificial Sequence
  Description of Artificial Sequence: Synthetic peptide
  XENP020068 vlCDR1
RASQSVGSSYLA

SEQ ID NO: 10363 - protein, 7 aa, Artificial Sequence
  Description of Artificial Sequence: Synthetic peptide
  XENP020068 vlCDR2
GAFSRAT

SEQ ID NO: 10364 - protein, 9 aa, Artificial Sequence
  Description of Artificial Sequence: Synthetic peptide
  XENP020068 vlCDR3
QQYGSSPWT

SEQ ID NO: 10365 - protein, 221 aa, Artificial Sequence
  Description of Artificial Sequence: Synthetic polypeptide
  XENP020069 [CTLA-4]_H3.2_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10366 - protein, 118 aa, Artificial Sequence; identical to SEQ ID NO: 7119
  Description of Artificial Sequence: Synthetic polypeptide
  VH of XENP020069

SEQ ID NO: 10367 - protein, 5 aa, Artificial Sequence
  Description of Artificial Sequence: Synthetic peptide
  XENP020069 vhCDR1
SYTMH

SEQ ID NO: 10368 - protein, 17 aa, Artificial Sequence
  Description of Artificial Sequence: Synthetic peptide
  XENP020069 vhCDR2
FISYDGNTKYYADSVKG

SEQ ID NO: 10369 - protein, 9 aa, Artificial Sequence
  Description of Artificial Sequence: Synthetic peptide
  XENP020069 vhCDR3
TGLLGPFDL

SEQ ID NO: 10370 - protein, 215 aa, Artificial Sequence; identical to SEQ ID NO: 9080
  Description of Artificial Sequence: Synthetic polypeptide
  XENP020069 [CTLA-4]_H3.2_L0.12_Fab Light Chain

SEQ ID NO: 10371 - protein, 108 aa, Artificial Sequence; identical to SEQ ID NO: 6193
  Description of Artificial Sequence: Synthetic polypeptide
  VL of XENP020069

SEQ ID NO: 10372 - protein, 12 aa, Artificial Sequence
  Description of Artificial Sequence: Synthetic peptide
  XENP020069 vlCDR1
RASQSVGSSYLA

SEQ ID NO: 10373 - protein, 7 aa, Artificial Sequence
  Description of Artificial Sequence: Synthetic peptide
  XENP020069 vlCDR2
GAFSRAT

SEQ ID NO: 10374 - protein, 9 aa, Artificial Sequence
  Description of Artificial Sequence: Synthetic peptide
  XENP020069 vlCDR3
QQYGSSPWT

SEQ ID NO: 10375 - protein, 221 aa, Artificial Sequence
  Description of Artificial Sequence: Synthetic polypeptide
  XENP020070 [CTLA-4]_H3.3_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10376 - protein, 118 aa, Artificial Sequence; identical to SEQ ID NO: 7128
  Description of Artificial Sequence: Synthetic polypeptide
  VH of XENP020070

SEQ ID NO: 10377 - protein, 5 aa, Artificial Sequence
  Description of Artificial Sequence: Synthetic peptide
  XENP020070 vhCDR1
SYTMH

SEQ ID NO: 10378 - protein, 17 aa, Artificial Sequence
  Description of Artificial Sequence: Synthetic peptide
  XENP020070 vhCDR2
FISYDGNQKYYADSVKG

SEQ ID NO: 10379 - protein, 9 aa, Artificial Sequence
  Description of Artificial Sequence: Synthetic peptide
  XENP020070 vhCDR3
TGLLGPFDL

SEQ ID NO: 10380 - protein, 215 aa, Artificial Sequence; identical to SEQ ID NO: 9080
  Description of Artificial Sequence: Synthetic polypeptide
  XENP020070 [CTLA-4]_H3.3_L0.12_Fab Light Chain

SEQ ID NO: 10381 - protein, 108 aa, Artificial Sequence; identical to SEQ ID NO: 6193
  Description of Artificial Sequence: Synthetic polypeptide
  VL of XENP020070

SEQ ID NO: 10382 - protein, 12 aa, Artificial Sequence
  Description of Artificial Sequence: Synthetic peptide
  XENP020070 vlCDR1
RASQSVGSSYLA

SEQ ID NO: 10383 - protein, 7 aa, Artificial Sequence
  Description of Artificial Sequence: Synthetic peptide
  XENP020070 vlCDR2
GAFSRAT

SEQ ID NO: 10384 - protein, 9 aa, Artificial Sequence
  Description of Artificial Sequence: Synthetic peptide
  XENP020070 vlCDR3
QQYGSSPWT

SEQ ID NO: 10385 - protein, 221 aa, Artificial Sequence
  Description of Artificial Sequence: Synthetic polypeptide
  XENP020071 [CTLA-4]_H3.4_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10386 - protein, 118 aa, Artificial Sequence; identical to SEQ ID NO: 7137
  Description of Artificial Sequence: Synthetic polypeptide
  VH of XENP020071

SEQ ID NO: 10387 - protein, 5 aa, Artificial Sequence
  Description of Artificial Sequence: Synthetic peptide
  XENP020071 vhCDR1
SYTMH

SEQ ID NO: 10388 - protein, 17 aa, Artificial Sequence
  Description of Artificial Sequence: Synthetic peptide
  XENP020071 vhCDR2
FISYDGNHKYYADSVKG

SEQ ID NO: 10389 - protein, 9 aa, Artificial Sequence
  Description of Artificial Sequence: Synthetic peptide
  XENP020071 vhCDR3
TGHLGPFDL

SEQ ID NO: 10390 - protein, 215 aa, Artificial Sequence; identical to SEQ ID NO: 9080
  Description of Artificial Sequence: Synthetic polypeptide
  XENP020071 [CTLA-4]_H3.4_L0.12_Fab Light Chain

SEQ ID NO: 10391 - protein, 108 aa, Artificial Sequence; identical to SEQ ID NO: 6193
  Description of Artificial Sequence: Synthetic polypeptide
  VL of XENP020071

SEQ ID NO: 10392 - protein, 12 aa, Artificial Sequence
  Description of Artificial Sequence: Synthetic peptide
  XENP020071 vlCDR1
RASQSVGSSYLA

SEQ ID NO: 10393 - protein, 7 aa, Artificial Sequence
  Description of Artificial Sequence: Synthetic peptide
  XENP020071 vlCDR2
GAFSRAT

SEQ ID NO: 10394 - protein, 9 aa, Artificial Sequence
  Description of Artificial Sequence: Synthetic peptide
  XENP020071 vlCDR3
QQYGSSPWT

SEQ ID NO: 10395 - protein, 221 aa, Artificial Sequence
  Description of Artificial Sequence: Synthetic polypeptide
  XENP020072 [CTLA-4]_H3.5_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10396 - protein, 118 aa, Artificial Sequence; identical to SEQ ID NO: 7146
  Description of Artificial Sequence: Synthetic polypeptide
  VH of XENP020072

SEQ ID NO: 10397 - protein, 5 aa, Artificial Sequence
  Description of Artificial Sequence: Synthetic peptide
  XENP020072 vhCDR1
SYTMH

SEQ ID NO: 10398 - protein, 17 aa, Artificial Sequence
  Description of Artificial Sequence: Synthetic peptide
  XENP020072 vhCDR2
FISYDGNTKYYADSVKG

SEQ ID NO: 10399 - protein, 9 aa, Artificial Sequence
  Description of Artificial Sequence: Synthetic peptide
  XENP020072 vhCDR3
TGHLGPFDL

SEQ ID NO: 10400 - protein, 215 aa, Artificial Sequence; identical to SEQ ID NO: 9080
  Description of Artificial Sequence: Synthetic polypeptide
  XENP020072 [CTLA-4]_H3.5_L0.12_Fab Light Chain

SEQ ID NO: 10401 - protein, 108 aa, Artificial Sequence; identical to SEQ ID NO: 6193
  Description of Artificial Sequence: Synthetic polypeptide
  VL of XENP020072

SEQ ID NO: 10402 - protein, 12 aa, Artificial Sequence
  Description of Artificial Sequence: Synthetic peptide
  XENP020072 vlCDR1
RASQSVGSSYLA

SEQ ID NO: 10403 - protein, 7 aa, Artificial Sequence
  Description of Artificial Sequence: Synthetic peptide
  XENP020072 vlCDR2
GAFSRAT

SEQ ID NO: 10404 - protein, 9 aa, Artificial Sequence
  Description of Artificial Sequence: Synthetic peptide
  XENP020072 vlCDR3
QQYGSSPWT

SEQ ID NO: 10405 - protein, 221 aa, Artificial Sequence
  Description of Artificial Sequence: Synthetic polypeptide
  XENP020073 [CTLA-4]_H3.6_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10406 - protein, 118 aa, Artificial Sequence; identical to SEQ ID NO: 7155
  Description of Artificial Sequence: Synthetic polypeptide
  VH of XENP020073

SEQ ID NO: 10407 - protein, 5 aa, Artificial Sequence
  Description of Artificial Sequence: Synthetic peptide
  XENP020073 vhCDR1
SYTMH

SEQ ID NO: 10408 - protein, 17 aa, Artificial Sequence
  Description of Artificial Sequence: Synthetic peptide
  XENP020073 vhCDR2
FISYDGNQKYYADSVKG

SEQ ID NO: 10409 - protein, 9 aa, Artificial Sequence
  Description of Artificial Sequence: Synthetic peptide
  XENP020073 vhCDR3
TGHLGPFDL

SEQ ID NO: 10410 - protein, 215 aa, Artificial Sequence; identical to SEQ ID NO: 9080
  Description of Artificial Sequence: Synthetic polypeptide
  XENP020073 [CTLA-4]_H3.6_L0.12_Fab Light Chain

SEQ ID NO: 10411 - protein, 108 aa, Artificial Sequence; identical to SEQ ID NO: 6193
  Description of Artificial Sequence: Synthetic polypeptide
  VL of XENP020073

SEQ ID NO: 10412 - protein, 12 aa, Artificial Sequence
  Description of Artificial Sequence: Synthetic peptide
  XENP020073 vlCDR1
RASQSVGSSYLA

SEQ ID NO: 10413 - protein, 7 aa, Artificial Sequence
  Description of Artificial Sequence: Synthetic peptide
  XENP020073 vlCDR2
GAFSRAT

SEQ ID NO: 10414 - protein, 9 aa, Artificial Sequence
  Description of Artificial Sequence: Synthetic peptide
  XENP020073 vlCDR3
QQYGSSPWT

SEQ ID NO: 10415 - protein, 221 aa, Artificial Sequence
  Description of Artificial Sequence: Synthetic polypeptide
  XENP020074 [CTLA-4]_H3.7_L0.12_Fab Heavy Chain
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10416 - protein, 118 aa, Artificial Sequence; identical to SEQ ID NO: 7164
  Description of Artificial Sequence: Synthetic polypeptide
  VH of XENP020074

SEQ ID NO: 10417 - protein, 5 aa, Artificial Sequence
  Description of Artificial Sequence: Synthetic peptide
  XENP020074 vhCDR1
SYTMH

SEQ ID NO: 10418 - protein, 17 aa, Artificial Sequence
  Description of Artificial Sequence: Synthetic peptide
  XENP020074 vhCDR2
FISYDGNNKYYADSVKG

SEQ ID NO: 10419 - protein, 9 aa, Artificial Sequence
  Description of Artificial Sequence: Synthetic peptide
  XENP020074 vhCDR3
TGWLGPFDY

SEQ ID NO: 10420 - protein, 215 aa, Artificial Sequence; identical to SEQ ID NO: 9080
  Description of Artificial Sequence: Synthetic polypeptide
  XENP020074 [CTLA-4]_H3.7_L0.12_Fab Light Chain

SEQ ID NO: 10421 - protein, 108 aa, Artificial Sequence; identical to SEQ ID NO: 6193
  Description of Artificial Sequence: Synthetic polypeptide
  VL of XENP020074

SEQ ID NO: 10422 - protein, 12 aa, Artificial Sequence
  Description of Artificial Sequence: Synthetic peptide
  XENP020074 vlCDR1
RASQSVGSSYLA

SEQ ID NO: 10423 - protein, 7 aa, Artificial Sequence
  Description of Artificial Sequence: Synthetic peptide
  XENP020074 vlCDR2
GAFSRAT

SEQ ID NO: 10424 - protein, 9 aa, Artificial Sequence
  Description of Artificial Sequence: Synthetic peptide
  XENP020074 vlCDR3
QQYGSSPWT

SEQ ID NO: 10425 - protein, 221 aa, Artificial Sequence
  Description of Artificial Sequence: Synthetic polypeptide
  XENP020323 [CTLA-4]_H3.9_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10426 - protein, 118 aa, Artificial Sequence; identical to SEQ ID NO: 7182
  Description of Artificial Sequence: Synthetic polypeptide
  VH of XENP020323

SEQ ID NO: 10427 - protein, 5 aa, Artificial Sequence
  Description of Artificial Sequence: Synthetic peptide
  XENP020323 vhCDR1
SYTMH

SEQ ID NO: 10428 - protein, 17 aa, Artificial Sequence
  Description of Artificial Sequence: Synthetic peptide
  XENP020323 vhCDR2
FISYDGNYKYYADSVKG

SEQ ID NO: 10429 - protein, 9 aa, Artificial Sequence
  Description of Artificial Sequence: Synthetic peptide
  XENP020323 vhCDR3
TGHLGPFDL

SEQ ID NO: 10430 - protein, 215 aa, Artificial Sequence; identical to SEQ ID NO: 9080
  Description of Artificial Sequence: Synthetic polypeptide
  XENP020323 [CTLA-4]_H3.9_L0.12_Fab Light Chain

SEQ ID NO: 10431 - protein, 108 aa, Artificial Sequence; identical to SEQ ID NO: 6193
  Description of Artificial Sequence: Synthetic polypeptide
  VL of XENP020323

SEQ ID NO: 10432 - protein, 12 aa, Artificial Sequence
  Description of Artificial Sequence: Synthetic peptide
  XENP020323 vlCDR1
RASQSVGSSYLA

SEQ ID NO: 10433 - protein, 7 aa, Artificial Sequence
  Description of Artificial Sequence: Synthetic peptide
  XENP020323 vlCDR2
GAFSRAT

SEQ ID NO: 10434 - protein, 9 aa, Artificial Sequence
  Description of Artificial Sequence: Synthetic peptide
  XENP020323 vlCDR3
QQYGSSPWT

SEQ ID NO: 10435 - protein, 221 aa, Artificial Sequence
  Description of Artificial Sequence: Synthetic polypeptide
  XENP020324 [CTLA-4]_H3.10_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10436 - protein, 118 aa, Artificial Sequence; identical to SEQ ID NO: 7191
  Description of Artificial Sequence: Synthetic polypeptide
  VH of XENP020324

SEQ ID NO: 10437 - protein, 5 aa, Artificial Sequence
  Description of Artificial Sequence: Synthetic peptide
  XENP020324 vhCDR1
SYTMH

SEQ ID NO: 10438 - protein, 17 aa, Artificial Sequence
  Description of Artificial Sequence: Synthetic peptide
  XENP020324 vhCDR2
FISYDGNYKYYADSVKG

SEQ ID NO: 10439 - protein, 9 aa, Artificial Sequence
  Description of Artificial Sequence: Synthetic peptide
  XENP020324 vhCDR3
TGLLGPFDL

SEQ ID NO: 10440 - protein, 215 aa, Artificial Sequence; identical to SEQ ID NO: 9080
  Description of Artificial Sequence: Synthetic polypeptide
  XENP020324 [CTLA-4]_H3.10_L0.12_Fab Light Chain

SEQ ID NO: 10441 - protein, 108 aa, Artificial Sequence; identical to SEQ ID NO: 6193
  Description of Artificial Sequence: Synthetic polypeptide
  VL of XENP020324

SEQ ID NO: 10442 - protein, 12 aa, Artificial Sequence
  Description of Artificial Sequence: Synthetic peptide
  XENP020324 vlCDR1
RASQSVGSSYLA

SEQ ID NO: 10443 - protein, 7 aa, Artificial Sequence
  Description of Artificial Sequence: Synthetic peptide
  XENP020324 vlCDR2
GAFSRAT

SEQ ID NO: 10444 - protein, 9 aa, Artificial Sequence
  Description of Artificial Sequence: Synthetic peptide
  XENP020324 vlCDR3
QQYGSSPWT

SEQ ID NO: 10445 - protein, 221 aa, Artificial Sequence
  Description of Artificial Sequence: Synthetic polypeptide
  XENP020325 [CTLA-4]_H3.11_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10446 - protein, 118 aa, Artificial Sequence; identical to SEQ ID NO: 7200
  Description of Artificial Sequence: Synthetic polypeptide
  VH of XENP020325

SEQ ID NO: 10447 - protein, 5 aa, Artificial Sequence
  Description of Artificial Sequence: Synthetic peptide
  XENP020325 vhCDR1
SYTMH

SEQ ID NO: 10448 - protein, 17 aa, Artificial Sequence
  Description of Artificial Sequence: Synthetic peptide
  XENP020325 vhCDR2
FISYDGNHKYYADSVKG

SEQ ID NO: 10449 - protein, 9 aa, Artificial Sequence
  Description of Artificial Sequence: Synthetic peptide
  XENP020325 vhCDR3
GGHLGPFDL

SEQ ID NO: 10450 - protein, 215 aa, Artificial Sequence; identical to SEQ ID NO: 9080
  Description of Artificial Sequence: Synthetic polypeptide
  XENP020325 [CTLA-4]_H3.11_L0.12_Fab Light Chain

SEQ ID NO: 10451 - protein, 108 aa, Artificial Sequence; identical to SEQ ID NO: 6193
  Description of Artificial Sequence: Synthetic polypeptide
  VL of XENP020325

SEQ ID NO: 10452 - protein, 12 aa, Artificial Sequence
  Description of Artificial Sequence: Synthetic peptide
  XENP020325 vlCDR1
RASQSVGSSYLA

SEQ ID NO: 10453 - protein, 7 aa, Artificial Sequence
  Description of Artificial Sequence: Synthetic peptide
  XENP020325 vlCDR2
GAFSRAT

SEQ ID NO: 10454 - protein, 9 aa, Artificial Sequence
  Description of Artificial Sequence: Synthetic peptide
  XENP020325 vlCDR3
QQYGSSPWT

SEQ ID NO: 10455 - protein, 221 aa, Artificial Sequence
  Description of Artificial Sequence: Synthetic polypeptide
  XENP020326 [CTLA-4]_H3.12_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10456 - protein, 118 aa, Artificial Sequence; identical to SEQ ID NO: 7209
  Description of Artificial Sequence: Synthetic polypeptide
  VH of XENP020326

SEQ ID NO: 10457 - protein, 5 aa, Artificial Sequence
  Description of Artificial Sequence: Synthetic peptide
  XENP020326 vhCDR1
SYTMH

SEQ ID NO: 10458 - protein, 17 aa, Artificial Sequence
  Description of Artificial Sequence: Synthetic peptide
  XENP020326 vhCDR2
FISYDGNHKYYADSVKG

SEQ ID NO: 10459 - protein, 9 aa, Artificial Sequence
  Description of Artificial Sequence: Synthetic peptide
  XENP020326 vhCDR3
TSHLGPFDL

SEQ ID NO: 10460 - protein, 215 aa, Artificial Sequence; identical to SEQ ID NO: 9080
  Description of Artificial Sequence: Synthetic polypeptide
  XENP020326 [CTLA-4]_H3.12_L0.12_Fab Light Chain

SEQ ID NO: 10461 - protein, 108 aa, Artificial Sequence; identical to SEQ ID NO: 6193
  Description of Artificial Sequence: Synthetic polypeptide
  VL of XENP020326

SEQ ID NO: 10462 - protein, 12 aa, Artificial Sequence
  Description of Artificial Sequence: Synthetic peptide
  XENP020326 vlCDR1
RASQSVGSSYLA

SEQ ID NO: 10463 - protein, 7 aa, Artificial Sequence
  Description of Artificial Sequence: Synthetic peptide
  XENP020326 vlCDR2
GAFSRAT

SEQ ID NO: 10464 - protein, 9 aa, Artificial Sequence
  Description of Artificial Sequence: Synthetic peptide
  XENP020326 vlCDR3
QQYGSSPWT

SEQ ID NO: 10465 - protein, 221 aa, Artificial Sequence
  Description of Artificial Sequence: Synthetic polypeptide
  XENP020327 [CTLA-4]_H3.13_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10466 - protein, 118 aa, Artificial Sequence; identical to SEQ ID NO: 7218
  Description of Artificial Sequence: Synthetic polypeptide
  VH of XENP020327

SEQ ID NO: 10467 - protein, 5 aa, Artificial Sequence
  Description of Artificial Sequence: Synthetic peptide
  XENP020327 vhCDR1
SYTMH

SEQ ID NO: 10468 - protein, 17 aa, Artificial Sequence
  Description of Artificial Sequence: Synthetic peptide
  XENP020327 vhCDR2
FISYDGNHKYYADSVKG

SEQ ID NO: 10469 - protein, 9 aa, Artificial Sequence
  Description of Artificial Sequence: Synthetic peptide
  XENP020327 vhCDR3
GGLLGPFDL

SEQ ID NO: 10470 - protein, 215 aa, Artificial Sequence; identical to SEQ ID NO: 9080
  Description of Artificial Sequence: Synthetic polypeptide
  XENP020327 [CTLA-4]_H3.13_L0.12_Fab Light Chain

SEQ ID NO: 10471 - protein, 108 aa, Artificial Sequence; identical to SEQ ID NO: 6193
  Description of Artificial Sequence: Synthetic polypeptide
  VL of XENP020327

SEQ ID NO: 10472 - protein, 12 aa, Artificial Sequence
  Description of Artificial Sequence: Synthetic peptide
  XENP020327 vlCDR1
RASQSVGSSYLA

SEQ ID NO: 10473 - protein, 7 aa, Artificial Sequence
  Description of Artificial Sequence: Synthetic peptide
  XENP020327 vlCDR2
GAFSRAT

SEQ ID NO: 10474 - protein, 9 aa, Artificial Sequence
  Description of Artificial Sequence: Synthetic peptide
  XENP020327 vlCDR3
QQYGSSPWT

SEQ ID NO: 10475 - protein, 221 aa, Artificial Sequence
  Description of Artificial Sequence: Synthetic polypeptide
  XENP020328 [CTLA-4]_H3.14_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10476 - protein, 118 aa, Artificial Sequence; identical to SEQ ID NO: 7227
  Description of Artificial Sequence: Synthetic polypeptide
  VH of XENP020328

SEQ ID NO: 10477 - protein, 5 aa, Artificial Sequence
  Description of Artificial Sequence: Synthetic peptide
  XENP020328 vhCDR1
SYTMH

SEQ ID NO: 10478 - protein, 17 aa, Artificial Sequence
  Description of Artificial Sequence: Synthetic peptide
  XENP020328 vhCDR2
FISYDGNHKYYADSVKG

SEQ ID NO: 10479 - protein, 9 aa, Artificial Sequence
  Description of Artificial Sequence: Synthetic peptide
  XENP020328 vhCDR3
TSLLGPFDL

SEQ ID NO: 10480 - protein, 215 aa, Artificial Sequence; identical to SEQ ID NO: 9080
  Description of Artificial Sequence: Synthetic polypeptide
  XENP020328 [CTLA-4]_H3.14_L0.12_Fab Light Chain

SEQ ID NO: 10481 - protein, 108 aa, Artificial Sequence; identical to SEQ ID NO: 6193
  Description of Artificial Sequence: Synthetic polypeptide
  VL of XENP020328

SEQ ID NO: 10482 - protein, 12 aa, Artificial Sequence
  Description of Artificial Sequence: Synthetic peptide
  XENP020328 vlCDR1
RASQSVGSSYLA

SEQ ID NO: 10483 - protein, 7 aa, Artificial Sequence
  Description of Artificial Sequence: Synthetic peptide
  XENP020328 vlCDR2
GAFSRAT

SEQ ID NO: 10484 - protein, 9 aa, Artificial Sequence
  Description of Artificial Sequence: Synthetic peptide
  XENP020328 vlCDR3
QQYGSSPWT

SEQ ID NO: 10485 - protein, 221 aa, Artificial Sequence
  Description of Artificial Sequence: Synthetic polypeptide
  XENP020329 [CTLA-4]_H3.15_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10486 - protein, 118 aa, Artificial Sequence; identical to SEQ ID NO: 7236
  Description of Artificial Sequence: Synthetic polypeptide
  VH of XENP020329

SEQ ID NO: 10487 - protein, 5 aa, Artificial Sequence
  Description of Artificial Sequence: Synthetic peptide
  XENP020329 vhCDR1
SYTMH

SEQ ID NO: 10488 - protein, 17 aa, Artificial Sequence
  Description of Artificial Sequence: Synthetic peptide
  XENP020329 vhCDR2
FISYDGNQKYYADSVKG

SEQ ID NO: 10489 - protein, 9 aa, Artificial Sequence
  Description of Artificial Sequence: Synthetic peptide
  XENP020329 vhCDR3
GGHLGPFDL

SEQ ID NO: 10490 - protein, 215 aa, Artificial Sequence; identical to SEQ ID NO: 9080
  Description of Artificial Sequence: Synthetic polypeptide
  XENP020329 [CTLA-4]_H3.15_L0.12_Fab Light Chain

SEQ ID NO: 10491 - protein, 108 aa, Artificial Sequence; identical to SEQ ID NO: 6193
  Description of Artificial Sequence: Synthetic polypeptide
  VL of XENP020329

SEQ ID NO: 10492 - protein, 12 aa, Artificial Sequence
  Description of Artificial Sequence: Synthetic peptide
  XENP020329 vlCDR1
RASQSVGSSYLA

SEQ ID NO: 10493 - protein, 7 aa, Artificial Sequence
  Description of Artificial Sequence: Synthetic peptide
  XENP020329 vlCDR2
GAFSRAT

SEQ ID NO: 10494 - protein, 9 aa, Artificial Sequence
  Description of Artificial Sequence: Synthetic peptide
  XENP020329 vlCDR3
QQYGSSPWT

SEQ ID NO: 10495 - protein, 221 aa, Artificial Sequence
  Description of Artificial Sequence: Synthetic polypeptide
  XENP020330 [CTLA-4]_H3.16_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10496 - protein, 118 aa, Artificial Sequence; identical to SEQ ID NO: 7245
  Description of Artificial Sequence: Synthetic polypeptide
  VH of XENP020330

SEQ ID NO: 10497 - protein, 5 aa, Artificial Sequence
  Description of Artificial Sequence: Synthetic peptide
  XENP020330 vhCDR1
SYTMH

SEQ ID NO: 10498 - protein, 17 aa, Artificial Sequence
  Description of Artificial Sequence: Synthetic peptide
  XENP020330 vhCDR2
FISYDGNQKYYADSVKG

SEQ ID NO: 10499 - protein, 9 aa, Artificial Sequence
  Description of Artificial Sequence: Synthetic peptide
  XENP020330 vhCDR3
TSHLGPFDL

SEQ ID NO: 10500 - protein, 215 aa, Artificial Sequence; identical to SEQ ID NO: 9080
  Description of Artificial Sequence: Synthetic polypeptide
  XENP020330 [CTLA-4]_H3.16_L0.12_Fab Light Chain

SEQ ID NO: 10501 - protein, 108 aa, Artificial Sequence; identical to SEQ ID NO: 6193
  Description of Artificial Sequence: Synthetic polypeptide
  VL of XENP020330

SEQ ID NO: 10502 - protein, 12 aa, Artificial Sequence
  Description of Artificial Sequence: Synthetic peptide
  XENP020330 vlCDR1
RASQSVGSSYLA

SEQ ID NO: 10503 - protein, 7 aa, Artificial Sequence
  Description of Artificial Sequence: Synthetic peptide
  XENP020330 vlCDR2
GAFSRAT

SEQ ID NO: 10504 - protein, 9 aa, Artificial Sequence
  Description of Artificial Sequence: Synthetic peptide
  XENP020330 vlCDR3
QQYGSSPWT

SEQ ID NO: 10505 - protein, 221 aa, Artificial Sequence
  Description of Artificial Sequence: Synthetic polypeptide
  XENP020331 [CTLA-4]_H3.17_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10506 - protein, 118 aa, Artificial Sequence; identical to SEQ ID NO: 7254
  Description of Artificial Sequence: Synthetic polypeptide
  VH of XENP020331

SEQ ID NO: 10507 - protein, 5 aa, Artificial Sequence
  Description of Artificial Sequence: Synthetic peptide
  XENP020331 vhCDR1
SYTMH

SEQ ID NO: 10508 - protein, 17 aa, Artificial Sequence
  Description of Artificial Sequence: Synthetic peptide
  XENP020331 vhCDR2
FISYDGNQKYYADSVKG

SEQ ID NO: 10509 - protein, 9 aa, Artificial Sequence
  Description of Artificial Sequence: Synthetic peptide
  XENP020331 vhCDR3
GGLLGPFDL

SEQ ID NO: 10510 - protein, 215 aa, Artificial Sequence; identical to SEQ ID NO: 9080
  Description of Artificial Sequence: Synthetic polypeptide
  XENP020331 [CTLA-4]_H3.17_L0.12_Fab Light Chain

SEQ ID NO: 10511 - protein, 108 aa, Artificial Sequence; identical to SEQ ID NO: 6193
  Description of Artificial Sequence: Synthetic polypeptide
  VL of XENP020331

SEQ ID NO: 10512 - protein, 12 aa, Artificial Sequence
  Description of Artificial Sequence: Synthetic peptide
  XENP020331 vlCDR1
RASQSVGSSYLA

SEQ ID NO: 10513 - protein, 7 aa, Artificial Sequence
  Description of Artificial Sequence: Synthetic peptide
  XENP020331 vlCDR2
GAFSRAT

SEQ ID NO: 10514 - protein, 9 aa, Artificial Sequence
  Description of Artificial Sequence: Synthetic peptide
  XENP020331 vlCDR3
QQYGSSPWT

SEQ ID NO: 10515 - protein, 221 aa, Artificial Sequence
  Description of Artificial Sequence: Synthetic polypeptide
  XENP020332 [CTLA-4]_H3.18_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10516 - protein, 118 aa, Artificial Sequence; identical to SEQ ID NO: 7263
  Description of Artificial Sequence: Synthetic polypeptide
  VH of XENP020332

SEQ ID NO: 10517 - protein, 5 aa, Artificial Sequence
  Description of Artificial Sequence: Synthetic peptide
  XENP020332 vhCDR1
SYTMH

SEQ ID NO: 10518 - protein, 17 aa, Artificial Sequence
  Description of Artificial Sequence: Synthetic peptide
  XENP020332 vhCDR2
FISYDGNQKYYADSVKG

SEQ ID NO: 10519 - protein, 9 aa, Artificial Sequence
  Description of Artificial Sequence: Synthetic peptide
  XENP020332 vhCDR3
TSLLGPFDL

SEQ ID NO: 10520 - protein, 215 aa, Artificial Sequence; identical to SEQ ID NO: 9080
  Description of Artificial Sequence: Synthetic polypeptide
  XENP020332 [CTLA-4]_H3.18_L0.12_Fab Light Chain

SEQ ID NO: 10521 - protein, 108 aa, Artificial Sequence; identical to SEQ ID NO: 6193
  Description of Artificial Sequence: Synthetic polypeptide
  VL of XENP020332

SEQ ID NO: 10522 - protein, 12 aa, Artificial Sequence
  Description of Artificial Sequence: Synthetic peptide
  XENP020332 vlCDR1
RASQSVGSSYLA

SEQ ID NO: 10523 - protein, 7 aa, Artificial Sequence
  Description of Artificial Sequence: Synthetic peptide
  XENP020332 vlCDR2
GAFSRAT

SEQ ID NO: 10524 - protein, 9 aa, Artificial Sequence
  Description of Artificial Sequence: Synthetic peptide
  XENP020332 vlCDR3
QQYGSSPWT

SEQ ID NO: 10525 - protein, 221 aa, Artificial Sequence
  Description of Artificial Sequence: Synthetic polypeptide
  XENP020333 [CTLA-4]_H3.19_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10526 - protein, 118 aa, Artificial Sequence; identical to SEQ ID NO: 7272
  Description of Artificial Sequence: Synthetic polypeptide
  VH of XENP020333

SEQ ID NO: 10527 - protein, 5 aa, Artificial Sequence
  Description of Artificial Sequence: Synthetic peptide
  XENP020333 vhCDR1
SYTMH

SEQ ID NO: 10528 - protein, 17 aa, Artificial Sequence
  Description of Artificial Sequence: Synthetic peptide
  XENP020333 vhCDR2
FISYDGNTKYYADSVKG

SEQ ID NO: 10529 - protein, 9 aa, Artificial Sequence
  Description of Artificial Sequence: Synthetic peptide
  XENP020333 vhCDR3
GGHLGPFDL

SEQ ID NO: 10530 - protein, 215 aa, Artificial Sequence; identical to SEQ ID NO: 9080
  Description of Artificial Sequence: Synthetic polypeptide
  XENP020333 [CTLA-4]_H3.19_L0.12_Fab Light Chain

SEQ ID NO: 10531 - protein, 108 aa, Artificial Sequence; identical to SEQ ID NO: 6193
  Description of Artificial Sequence: Synthetic polypeptide
  VL of XENP020333

SEQ ID NO: 10532 - protein, 12 aa, Artificial Sequence
  Description of Artificial Sequence: Synthetic peptide
  XENP020333 vlCDR1
RASQSVGSSYLA

SEQ ID NO: 10533 - protein, 7 aa, Artificial Sequence
  Description of Artificial Sequence: Synthetic peptide
  XENP020333 vlCDR2
GAFSRAT

SEQ ID NO: 10534 - protein, 9 aa, Artificial Sequence
  Description of Artificial Sequence: Synthetic peptide
  XENP020333 vlCDR3
QQYGSSPWT

SEQ ID NO: 10535 - protein, 221 aa, Artificial Sequence
  Description of Artificial Sequence: Synthetic polypeptide
  XENP020334 [CTLA-4]_H3.20_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10536 - protein, 118 aa, Artificial Sequence; identical to SEQ ID NO: 7281
  Description of Artificial Sequence: Synthetic polypeptide
  VH of XENP020334

SEQ ID NO: 10537 - protein, 5 aa, Artificial Sequence
  Description of Artificial Sequence: Synthetic peptide
  XENP020334 vhCDR1
SYTMH

SEQ ID NO: 10538 - protein, 17 aa, Artificial Sequence
  Description of Artificial Sequence: Synthetic peptide
  XENP020334 vhCDR2
FISYDGNTKYYADSVKG

SEQ ID NO: 10539 - protein, 9 aa, Artificial Sequence
  Description of Artificial Sequence: Synthetic peptide
  XENP020334 vhCDR3
TSHLGPFDL

SEQ ID NO: 10540 - protein, 215 aa, Artificial Sequence; identical to SEQ ID NO: 9080
  Description of Artificial Sequence: Synthetic polypeptide
  XENP020334 [CTLA-4]_H3.20_L0.12_Fab Light Chain

SEQ ID NO: 10541 - protein, 108 aa, Artificial Sequence; identical to SEQ ID NO: 6193
  Description of Artificial Sequence: Synthetic polypeptide
  VL of XENP020334

SEQ ID NO: 10542 - protein, 12 aa, Artificial Sequence
  Description of Artificial Sequence: Synthetic peptide
  XENP020334 vlCDR1
RASQSVGSSYLA

SEQ ID NO: 10543 - protein, 7 aa, Artificial Sequence
  Description of Artificial Sequence: Synthetic peptide
  XENP020334 vlCDR2
GAFSRAT

SEQ ID NO: 10544 - protein, 9 aa, Artificial Sequence
  Description of Artificial Sequence: Synthetic peptide
  XENP020334 vlCDR3
QQYGSSPWT

SEQ ID NO: 10545 - protein, 221 aa, Artificial Sequence
  Description of Artificial Sequence: Synthetic polypeptide
  XENP020335 [CTLA-4]_H3.21_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10546 - protein, 118 aa, Artificial Sequence; identical to SEQ ID NO: 7290
  Description of Artificial Sequence: Synthetic polypeptide
  VH of XENP020335

SEQ ID NO: 10547 - protein, 5 aa, Artificial Sequence
  Description of Artificial Sequence: Synthetic peptide
  XENP020335 vhCDR1
SYTMH

SEQ ID NO: 10548 - protein, 17 aa, Artificial Sequence
  Description of Artificial Sequence: Synthetic peptide
  XENP020335 vhCDR2
FISYDGNTKYYADSVKG

SEQ ID NO: 10549 - protein, 9 aa, Artificial Sequence
  Description of Artificial Sequence: Synthetic peptide
  XENP020335 vhCDR3
GGLLGPFDL

SEQ ID NO: 10550 - protein, 215 aa, Artificial Sequence; identical to SEQ ID NO: 9080
  Description of Artificial Sequence: Synthetic polypeptide
  XENP020335 [CTLA-4]_H3.21_L0.12_Fab Light Chain

SEQ ID NO: 10551 - protein, 108 aa, Artificial Sequence; identical to SEQ ID NO: 6193
  Description of Artificial Sequence: Synthetic polypeptide
  VL of XENP020335

SEQ ID NO: 10552 - protein, 12 aa, Artificial Sequence
  Description of Artificial Sequence: Synthetic peptide
  XENP020335 vlCDR1
RASQSVGSSYLA

SEQ ID NO: 10553 - protein, 7 aa, Artificial Sequence
  Description of Artificial Sequence: Synthetic peptide
  XENP020335 vlCDR2
GAFSRAT

SEQ ID NO: 10554 - protein, 9 aa, Artificial Sequence
  Description of Artificial Sequence: Synthetic peptide
  XENP020335 vlCDR3
QQYGSSPWT

SEQ ID NO: 10555 - protein, 221 aa, Artificial Sequence
  Description of Artificial Sequence: Synthetic polypeptide
  XENP020336 [CTLA-4]_H3.22_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10556 - protein, 118 aa, Artificial Sequence; identical to SEQ ID NO: 7299
  Description of Artificial Sequence: Synthetic polypeptide
  VH of XENP020336

SEQ ID NO: 10557 - protein, 5 aa, Artificial Sequence
  Description of Artificial Sequence: Synthetic peptide
  XENP020336 vhCDR1
SYTMH

SEQ ID NO: 10558 - protein, 17 aa, Artificial Sequence
  Description of Artificial Sequence: Synthetic peptide
  XENP020336 vhCDR2
FISYDGNTKYYADSVKG

SEQ ID NO: 10559 - protein, 9 aa, Artificial Sequence
  Description of Artificial Sequence: Synthetic peptide
  XENP020336 vhCDR3
TSLLGPFDL

SEQ ID NO: 10560 - protein, 215 aa, Artificial Sequence; identical to SEQ ID NO: 9080
  Description of Artificial Sequence: Synthetic polypeptide
  XENP020336 [CTLA-4]_H3.22_L0.12_Fab Light Chain

SEQ ID NO: 10561 - protein, 108 aa, Artificial Sequence; identical to SEQ ID NO: 6193
  Description of Artificial Sequence: Synthetic polypeptide
  VL of XENP020336

SEQ ID NO: 10562 - protein, 12 aa, Artificial Sequence
  Description of Artificial Sequence: Synthetic peptide
  XENP020336 vlCDR1
RASQSVGSSYLA

SEQ ID NO: 10563 - protein, 7 aa, Artificial Sequence
  Description of Artificial Sequence: Synthetic peptide
  XENP020336 vlCDR2
GAFSRAT

SEQ ID NO: 10564 - protein, 9 aa, Artificial Sequence
  Description of Artificial Sequence: Synthetic peptide
  XENP020336 vlCDR3
QQYGSSPWT

SEQ ID NO: 10565 - protein, 221 aa, Artificial Sequence
  Description of Artificial Sequence: Synthetic polypeptide
  XENP020337 [CTLA-4]_H3.23_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10566 - protein, 118 aa, Artificial Sequence; identical to SEQ ID NO: 2395
  Description of Artificial Sequence: Synthetic polypeptide
  VH of XENP020337

SEQ ID NO: 10567 - protein, 5 aa, Artificial Sequence
  Description of Artificial Sequence: Synthetic peptide
  XENP020337 vhCDR1
SYTMH

SEQ ID NO: 10568 - protein, 17 aa, Artificial Sequence
  Description of Artificial Sequence: Synthetic peptide
  XENP020337 vhCDR2
FISYDGNYKYYADSVKG

SEQ ID NO: 10569 - protein, 9 aa, Artificial Sequence
  Description of Artificial Sequence: Synthetic peptide
  XENP020337 vhCDR3
GGHLGPFDL

SEQ ID NO: 10570 - protein, 215 aa, Artificial Sequence; identical to SEQ ID NO: 9080
  Description of Artificial Sequence: Synthetic polypeptide
  XENP020337 [CTLA-4]_H3.23_L0.12_Fab Light Chain

SEQ ID NO: 10571 - protein, 108 aa, Artificial Sequence; identical to SEQ ID NO: 6193
  Description of Artificial Sequence: Synthetic polypeptide
  VL of XENP020337

SEQ ID NO: 10572 - protein, 12 aa, Artificial Sequence
  Description of Artificial Sequence: Synthetic peptide
  XENP020337 vlCDR1
RASQSVGSSYLA

SEQ ID NO: 10573 - protein, 7 aa, Artificial Sequence
  Description of Artificial Sequence: Synthetic peptide
  XENP020337 vlCDR2
GAFSRAT

SEQ ID NO: 10574 - protein, 9 aa, Artificial Sequence
  Description of Artificial Sequence: Synthetic peptide
  XENP020337 vlCDR3
QQYGSSPWT

SEQ ID NO: 10575 - protein, 221 aa, Artificial Sequence
  Description of Artificial Sequence: Synthetic polypeptide
  XENP020338 [CTLA-4]_H3.24_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10576 - protein, 118 aa, Artificial Sequence; identical to SEQ ID NO: 7317
  Description of Artificial Sequence: Synthetic polypeptide
  VH of XENP020338

SEQ ID NO: 10577 - protein, 5 aa, Artificial Sequence
  Description of Artificial Sequence: Synthetic peptide
  XENP020338 vhCDR1
SYTMH

SEQ ID NO: 10578 - protein, 17 aa, Artificial Sequence
  Description of Artificial Sequence: Synthetic peptide
  XENP020338 vhCDR2
FISYDGNYKYYADSVKG

SEQ ID NO: 10579 - protein, 9 aa, Artificial Sequence
  Description of Artificial Sequence: Synthetic peptide
  XENP020338 vhCDR3
TSHLGPFDL

SEQ ID NO: 10580 - protein, 215 aa, Artificial Sequence; identical to SEQ ID NO: 9080
  Description of Artificial Sequence: Synthetic polypeptide
  XENP020338 [CTLA-4]_H3.24_L0.12_Fab Light Chain

SEQ ID NO: 10581 - protein, 108 aa, Artificial Sequence; identical to SEQ ID NO: 6193
  Description of Artificial Sequence: Synthetic polypeptide
  VL of XENP020338

SEQ ID NO: 10582 - protein, 12 aa, Artificial Sequence
  Description of Artificial Sequence: Synthetic peptide
  XENP020338 vlCDR1
RASQSVGSSYLA

SEQ ID NO: 10583 - protein, 7 aa, Artificial Sequence
  Description of Artificial Sequence: Synthetic peptide
  XENP020338 vlCDR2
GAFSRAT

SEQ ID NO: 10584 - protein, 9 aa, Artificial Sequence
  Description of Artificial Sequence: Synthetic peptide
  XENP020338 vlCDR3
QQYGSSPWT

SEQ ID NO: 10585 - protein, 221 aa, Artificial Sequence
  Description of Artificial Sequence: Synthetic polypeptide
  XENP020339 [CTLA-4]_H3.25_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10586 - protein, 118 aa, Artificial Sequence; identical to SEQ ID NO: 7326
  Description of Artificial Sequence: Synthetic polypeptide
  VH of XENP020339

SEQ ID NO: 10587 - protein, 5 aa, Artificial Sequence
  Description of Artificial Sequence: Synthetic peptide
  XENP020339 vhCDR1
SYTMH

SEQ ID NO: 10588 - protein, 17 aa, Artificial Sequence
  Description of Artificial Sequence: Synthetic peptide
  XENP020339 vhCDR2
FISYDGNYKYYADSVKG

SEQ ID NO: 10589 - protein, 9 aa, Artificial Sequence
  Description of Artificial Sequence: Synthetic peptide
  XENP020339 vhCDR3
GGLLGPFDL

SEQ ID NO: 10590 - protein, 215 aa, Artificial Sequence; identical to SEQ ID NO: 9080
  Description of Artificial Sequence: Synthetic polypeptide
  XENP020339 [CTLA-4]_H3.25_L0.12_Fab Light Chain

SEQ ID NO: 10591 - protein, 108 aa, Artificial Sequence; identical to SEQ ID NO: 6193
  Description of Artificial Sequence: Synthetic polypeptide
  VL of XENP020339

SEQ ID NO: 10592 - protein, 12 aa, Artificial Sequence
  Description of Artificial Sequence: Synthetic peptide
  XENP020339 vlCDR1
RASQSVGSSYLA

SEQ ID NO: 10593 - protein, 7 aa, Artificial Sequence
  Description of Artificial Sequence: Synthetic peptide
  XENP020339 vlCDR2
GAFSRAT

SEQ ID NO: 10594 - protein, 9 aa, Artificial Sequence
  Description of Artificial Sequence: Synthetic peptide
  XENP020339 vlCDR3
QQYGSSPWT

SEQ ID NO: 10595 - protein, 221 aa, Artificial Sequence
  Description of Artificial Sequence: Synthetic polypeptide
  XENP020340 [CTLA-4]_H3.26_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10596 - protein, 118 aa, Artificial Sequence; identical to SEQ ID NO: 7335
  Description of Artificial Sequence: Synthetic polypeptide
  VH of XENP020340

SEQ ID NO: 10597 - protein, 5 aa, Artificial Sequence
  Description of Artificial Sequence: Synthetic peptide
  XENP020340 vhCDR1
SYTMH

SEQ ID NO: 10598 - protein, 17 aa, Artificial Sequence
  Description of Artificial Sequence: Synthetic peptide
  XENP020340 vhCDR2
FISYDGNYKYYADSVKG

SEQ ID NO: 10599 - protein, 9 aa, Artificial Sequence
  Description of Artificial Sequence: Synthetic peptide
  XENP020340 vhCDR3
TSLLGPFDL

SEQ ID NO: 10600 - protein, 215 aa, Artificial Sequence; identical to SEQ ID NO: 9080
  Description of Artificial Sequence: Synthetic polypeptide
  XENP020340 [CTLA-4]_H3.26_L0.12_Fab Light Chain

SEQ ID NO: 10601 - protein, 108 aa, Artificial Sequence; identical to SEQ ID NO: 6193
  Description of Artificial Sequence: Synthetic polypeptide
  VL of XENP020340

SEQ ID NO: 10602 - protein, 12 aa, Artificial Sequence
  Description of Artificial Sequence: Synthetic peptide
  XENP020340 vlCDR1
RASQSVGSSYLA

SEQ ID NO: 10603 - protein, 7 aa, Artificial Sequence
  Description of Artificial Sequence: Synthetic peptide
  XENP020340 vlCDR2
GAFSRAT

SEQ ID NO: 10604 - protein, 9 aa, Artificial Sequence
  Description of Artificial Sequence: Synthetic peptide
  XENP020340 vlCDR3
QQYGSSPWT

SEQ ID NO: 10605 - protein, 221 aa, Artificial Sequence; identical to SEQ ID NO: 10385
  Description of Artificial Sequence: Synthetic polypeptide
  XENP020341 [CTLA-4]_H3.4_L0.118_Fab Heavy Chain

SEQ ID NO: 10606 - protein, 118 aa, Artificial Sequence; identical to SEQ ID NO: 7137
  Description of Artificial Sequence: Synthetic polypeptide
  VH of XENP020341

SEQ ID NO: 10607 - protein, 5 aa, Artificial Sequence
  Description of Artificial Sequence: Synthetic peptide
  XENP020341 vhCDR1
SYTMH

SEQ ID NO: 10608 - protein, 17 aa, Artificial Sequence
  Description of Artificial Sequence: Synthetic peptide
  XENP020341 vhCDR2
FISYDGNHKYYADSVKG

SEQ ID NO: 10609 - protein, 9 aa, Artificial Sequence
  Description of Artificial Sequence: Synthetic peptide
  XENP020341 vhCDR3
TGHLGPFDL

SEQ ID NO: 10610 - protein, 215 aa, Artificial Sequence
  Description of Artificial Sequence: Synthetic polypeptide
  XENP020341 [CTLA-4]_H3.4_L0.118_Fab Light Chain
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10611 - protein, 108 aa, Artificial Sequence; identical to SEQ ID NO: 7345
  Description of Artificial Sequence: Synthetic polypeptide
  VL of XENP020341

SEQ ID NO: 10612 - protein, 12 aa, Artificial Sequence
  Description of Artificial Sequence: Synthetic peptide
  XENP020341 vlCDR1
RASQSVGSSYLA

SEQ ID NO: 10613 - protein, 7 aa, Artificial Sequence
  Description of Artificial Sequence: Synthetic peptide
  XENP020341 vlCDR2
GAFSRAT

SEQ ID NO: 10614 - protein, 9 aa, Artificial Sequence
  Description of Artificial Sequence: Synthetic peptide
  XENP020341 vlCDR3
QQYGSSPWT

SEQ ID NO: 10615 - protein, 221 aa, Artificial Sequence; identical to SEQ ID NO: 10385
  Description of Artificial Sequence: Synthetic polypeptide
  XENP020342 [CTLA-4]_H3.4_L0.119_Fab Heavy Chain

SEQ ID NO: 10616 - protein, 118 aa, Artificial Sequence; identical to SEQ ID NO: 7137
  Description of Artificial Sequence: Synthetic polypeptide
  VH of XENP020342

SEQ ID NO: 10617 - protein, 5 aa, Artificial Sequence
  Description of Artificial Sequence: Synthetic peptide
  XENP020342 vhCDR1
SYTMH

SEQ ID NO: 10618 - protein, 17 aa, Artificial Sequence
  Description of Artificial Sequence: Synthetic peptide
  XENP020342 vhCDR2
FISYDGNHKYYADSVKG

SEQ ID NO: 10619 - protein, 9 aa, Artificial Sequence
  Description of Artificial Sequence: Synthetic peptide
  XENP020342 vhCDR3
TGHLGPFDL

SEQ ID NO: 10620 - protein, 215 aa, Artificial Sequence; identical to SEQ ID NO: 7600
  Description of Artificial Sequence: Synthetic polypeptide
  XENP020342 [CTLA-4]_H3.4_L0.119_Fab Light Chain

SEQ ID NO: 10621 - protein, 108 aa, Artificial Sequence; identical to SEQ ID NO: 3741
  Description of Artificial Sequence: Synthetic polypeptide
  VL of XENP020342

SEQ ID NO: 10622 - protein, 12 aa, Artificial Sequence
  Description of Artificial Sequence: Synthetic peptide
  XENP020342 vlCDR1
RASQSVGSSYLA

SEQ ID NO: 10623 - protein, 7 aa, Artificial Sequence
  Description of Artificial Sequence: Synthetic peptide
  XENP020342 vlCDR2
GAFSRAT

SEQ ID NO: 10624 - protein, 9 aa, Artificial Sequence
  Description of Artificial Sequence: Synthetic peptide
  XENP020342 vlCDR3
QQYGSSPWT

SEQ ID NO: 10625 - protein, 221 aa, Artificial Sequence; identical to SEQ ID NO: 10385
  Description of Artificial Sequence: Synthetic polypeptide
  XENP020343 [CTLA-4]_H3.4_L0.120_Fab Heavy Chain

SEQ ID NO: 10626 - protein, 118 aa, Artificial Sequence; identical to SEQ ID NO: 7137
  Description of Artificial Sequence: Synthetic polypeptide
  VH of XENP020343

SEQ ID NO: 10627 - protein, 5 aa, Artificial Sequence
  Description of Artificial Sequence: Synthetic peptide
  XENP020343 vhCDR1
SYTMH

SEQ ID NO: 10628 - protein, 17 aa, Artificial Sequence
  Description of Artificial Sequence: Synthetic peptide
  XENP020343 vhCDR2
FISYDGNHKYYADSVKG

SEQ ID NO: 10629 - protein, 9 aa, Artificial Sequence
  Description of Artificial Sequence: Synthetic peptide
  XENP020343 vhCDR3
TGHLGPFDL

SEQ ID NO: 10630 - protein, 215 aa, Artificial Sequence
  Description of Artificial Sequence: Synthetic polypeptide
  XENP020343 [CTLA-4]_H3.4_L0.120_Fab Light Chain
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10631 - protein, 108 aa, Artificial Sequence; identical to SEQ ID NO: 7363
  Description of Artificial Sequence: Synthetic polypeptide
  VL of XENP020343

SEQ ID NO: 10632 - protein, 12 aa, Artificial Sequence
  Description of Artificial Sequence: Synthetic peptide
  XENP020343 vlCDR1
RASQSVSSSYLA

SEQ ID NO: 10633 - protein, 7 aa, Artificial Sequence
  Description of Artificial Sequence: Synthetic peptide
  XENP020343 vlCDR2
GAFSRAT

SEQ ID NO: 10634 - protein, 9 aa, Artificial Sequence
  Description of Artificial Sequence: Synthetic peptide
  XENP020343 vlCDR3
QQYGSSPWT

SEQ ID NO: 10635 - protein, 221 aa, Artificial Sequence; identical to SEQ ID NO: 10385
  Description of Artificial Sequence: Synthetic polypeptide
  XENP020344 [CTLA-4]_H3.4_L0.121_Fab Heavy Chain

SEQ ID NO: 10636 - protein, 118 aa, Artificial Sequence; identical to SEQ ID NO: 7137
  Description of Artificial Sequence: Synthetic polypeptide
  VH of XENP020344

SEQ ID NO: 10637 - protein, 5 aa, Artificial Sequence
  Description of Artificial Sequence: Synthetic peptide
  XENP020344 vhCDR1
SYTMH

SEQ ID NO: 10638 - protein, 17 aa, Artificial Sequence
  Description of Artificial Sequence: Synthetic peptide
  XENP020344 vhCDR2
FISYDGNHKYYADSVKG

SEQ ID NO: 10639 - protein, 9 aa, Artificial Sequence
  Description of Artificial Sequence: Synthetic peptide
  XENP020344 vhCDR3
TGHLGPFDL

SEQ ID NO: 10640 - protein, 215 aa, Artificial Sequence
  Description of Artificial Sequence: Synthetic polypeptide
  XENP020344 [CTLA-4]_H3.4_L0.121_Fab Light Chain
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10641 - protein, 108 aa, Artificial Sequence; identical to SEQ ID NO: 7372
  Description of Artificial Sequence: Synthetic polypeptide
  VL of XENP020344

SEQ ID NO: 10642 - protein, 12 aa, Artificial Sequence
  Description of Artificial Sequence: Synthetic peptide
  XENP020344 vlCDR1
RASQSVGSSYLA

SEQ ID NO: 10643 - protein, 7 aa, Artificial Sequence
  Description of Artificial Sequence: Synthetic peptide
  XENP020344 vlCDR2
GASSRAT

SEQ ID NO: 10644 - protein, 9 aa, Artificial Sequence
  Description of Artificial Sequence: Synthetic peptide
  XENP020344 vlCDR3
QQYGSSPWT

SEQ ID NO: 10645 - protein, 221 aa, Artificial Sequence; identical to SEQ ID NO: 10385
  Description of Artificial Sequence: Synthetic polypeptide
  XENP020345 [CTLA-4]_H3.4_L0.122_Fab Heavy Chain

SEQ ID NO: 10646 - protein, 118 aa, Artificial Sequence; identical to SEQ ID NO: 7137
  Description of Artificial Sequence: Synthetic polypeptide
  VH of XENP020345

SEQ ID NO: 10647 - protein, 5 aa, Artificial Sequence
  Description of Artificial Sequence: Synthetic peptide
  XENP020345 vhCDR1
SYTMH

SEQ ID NO: 10648 - protein, 17 aa, Artificial Sequence
  Description of Artificial Sequence: Synthetic peptide
  XENP020345 vhCDR2
FISYDGNHKYYADSVKG

SEQ ID NO: 10649 - protein, 9 aa, Artificial Sequence
  Description of Artificial Sequence: Synthetic peptide
  XENP020345 vhCDR3
TGHLGPFDL

SEQ ID NO: 10650 - protein, 215 aa, Artificial Sequence; identical to SEQ ID NO: 9040
  Description of Artificial Sequence: Synthetic polypeptide
  XENP020345 [CTLA-4]_H3.4_L0.122_Fab Light Chain

SEQ ID NO: 10651 - protein, 108 aa, Artificial Sequence; identical to SEQ ID NO: 6157
  Description of Artificial Sequence: Synthetic polypeptide
  VL of XENP020345

SEQ ID NO: 10652 - protein, 12 aa, Artificial Sequence
  Description of Artificial Sequence: Synthetic peptide
  XENP020345 vlCDR1
RASQSVGSSYLA

SEQ ID NO: 10653 - protein, 7 aa, Artificial Sequence
  Description of Artificial Sequence: Synthetic peptide
  XENP020345 vlCDR2
GAFSRAT

SEQ ID NO: 10654 - protein, 9 aa, Artificial Sequence
  Description of Artificial Sequence: Synthetic peptide
  XENP020345 vlCDR3
QQYGSSPWT

SEQ ID NO: 10655 - protein, 221 aa, Artificial Sequence; identical to SEQ ID NO: 10385
  Description of Artificial Sequence: Synthetic polypeptide
  XENP020346 [CTLA-4]_H3.4_L0.123_Fab Heavy Chain

SEQ ID NO: 10656 - protein, 118 aa, Artificial Sequence; identical to SEQ ID NO: 7137
  Description of Artificial Sequence: Synthetic polypeptide
  VH of XENP020346

SEQ ID NO: 10657 - protein, 5 aa, Artificial Sequence
  Description of Artificial Sequence: Synthetic peptide
  XENP020346 vhCDR1
SYTMH

SEQ ID NO: 10658 - protein, 17 aa, Artificial Sequence
  Description of Artificial Sequence: Synthetic peptide
  XENP020346 vhCDR2
FISYDGNHKYYADSVKG

SEQ ID NO: 10659 - protein, 9 aa, Artificial Sequence
  Description of Artificial Sequence: Synthetic peptide
  XENP020346 vhCDR3
TGHLGPFDL

SEQ ID NO: 10660 - protein, 215 aa, Artificial Sequence
  Description of Artificial Sequence: Synthetic polypeptide
  XENP020346 [CTLA-4]_H3.4_L0.123_Fab Light Chain
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10661 - protein, 108 aa, Artificial Sequence; identical to SEQ ID NO: 7390
  Description of Artificial Sequence: Synthetic polypeptide
  VL of XENP020346

SEQ ID NO: 10662 - protein, 12 aa, Artificial Sequence
  Description of Artificial Sequence: Synthetic peptide
  XENP020346 vlCDR1
RASQSVSSSYLA

SEQ ID NO: 10663 - protein, 7 aa, Artificial Sequence
  Description of Artificial Sequence: Synthetic peptide
  XENP020346 vlCDR2
GAFSRAT

SEQ ID NO: 10664 - protein, 9 aa, Artificial Sequence
  Description of Artificial Sequence: Synthetic peptide
  XENP020346 vlCDR3
QQYGSSPWT

SEQ ID NO: 10665 - protein, 221 aa, Artificial Sequence; identical to SEQ ID NO: 10385
  Description of Artificial Sequence: Synthetic polypeptide
  XENP020347 [CTLA-4]_H3.4_L0.124_Fab Heavy Chain

SEQ ID NO: 10666 - protein, 118 aa, Artificial Sequence; identical to SEQ ID NO: 7137
  Description of Artificial Sequence: Synthetic polypeptide
  VH of XENP020347

SEQ ID NO: 10667 - protein, 5 aa, Artificial Sequence
  Description of Artificial Sequence: Synthetic peptide
  XENP020347 vhCDR1
SYTMH

SEQ ID NO: 10668 - protein, 17 aa, Artificial Sequence
  Description of Artificial Sequence: Synthetic peptide
  XENP020347 vhCDR2
FISYDGNHKYYADSVKG

SEQ ID NO: 10669 - protein, 9 aa, Artificial Sequence
  Description of Artificial Sequence: Synthetic peptide
  XENP020347 vhCDR3
TGHLGPFDL

SEQ ID NO: 10670 - protein, 215 aa, Artificial Sequence
  Description of Artificial Sequence: Synthetic polypeptide
  XENP020347 [CTLA-4]_H3.4_L0.124_Fab Light Chain
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10671 - protein, 108 aa, Artificial Sequence; identical to SEQ ID NO: 7399
  Description of Artificial Sequence: Synthetic polypeptide
  VL of XENP020347

SEQ ID NO: 10672 - protein, 12 aa, Artificial Sequence
  Description of Artificial Sequence: Synthetic peptide
  XENP020347 vlCDR1
RASQSVGSSYLA

SEQ ID NO: 10673 - protein, 7 aa, Artificial Sequence
  Description of Artificial Sequence: Synthetic peptide
  XENP020347 vlCDR2
GASSRAT

SEQ ID NO: 10674 - protein, 9 aa, Artificial Sequence
  Description of Artificial Sequence: Synthetic peptide
  XENP020347 vlCDR3
QQYGSSPWT

SEQ ID NO: 10675 - protein, 221 aa, Artificial Sequence; identical to SEQ ID NO: 10385
  Description of Artificial Sequence: Synthetic polypeptide
  XENP020348 [CTLA-4]_H3.4_L0.125_Fab Heavy Chain

SEQ ID NO: 10676 - protein, 118 aa, Artificial Sequence; identical to SEQ ID NO: 7137
  Description of Artificial Sequence: Synthetic polypeptide
  VH of XENP020348

SEQ ID NO: 10677 - protein, 5 aa, Artificial Sequence
  Description of Artificial Sequence: Synthetic peptide
  XENP020348 vhCDR1
SYTMH

SEQ ID NO: 10678 - protein, 17 aa, Artificial Sequence
  Description of Artificial Sequence: Synthetic peptide
  XENP020348 vhCDR2
FISYDGNHKYYADSVKG

SEQ ID NO: 10679 - protein, 9 aa, Artificial Sequence
  Description of Artificial Sequence: Synthetic peptide
  XENP020348 vhCDR3
TGHLGPFDL

SEQ ID NO: 10680 - protein, 215 aa, Artificial Sequence; identical to SEQ ID NO: 2410
  Description of Artificial Sequence: Synthetic polypeptide
  XENP020348 [CTLA-4]_H3.4_L0.125_Fab Light Chain

SEQ ID NO: 10681 - protein, 108 aa, Artificial Sequence; identical to SEQ ID NO: 2411
  Description of Artificial Sequence: Synthetic polypeptide
  VL of XENP020348

SEQ ID NO: 10682 - protein, 12 aa, Artificial Sequence
  Description of Artificial Sequence: Synthetic peptide
  XENP020348 vlCDR1
RASQSVSSSYLA

SEQ ID NO: 10683 - protein, 7 aa, Artificial Sequence
  Description of Artificial Sequence: Synthetic peptide
  XENP020348 vlCDR2
GAFSRAT

SEQ ID NO: 10684 - protein, 9 aa, Artificial Sequence
  Description of Artificial Sequence: Synthetic peptide
  XENP020348 vlCDR3
QQYGSSPWT

SEQ ID NO: 10685 - protein, 221 aa, Artificial Sequence; identical to SEQ ID NO: 10385
  Description of Artificial Sequence: Synthetic polypeptide
  XENP020349 [CTLA-4]_H3.4_L0.126_Fab Heavy Chain

SEQ ID NO: 10686 - protein, 118 aa, Artificial Sequence; identical to SEQ ID NO: 7137
  Description of Artificial Sequence: Synthetic polypeptide
  VH of XENP020349

SEQ ID NO: 10687 - protein, 5 aa, Artificial Sequence
  Description of Artificial Sequence: Synthetic peptide
  XENP020349 vhCDR1
SYTMH

SEQ ID NO: 10688 - protein, 17 aa, Artificial Sequence
  Description of Artificial Sequence: Synthetic peptide
  XENP020349 vhCDR2
FISYDGNHKYYADSVKG

SEQ ID NO: 10689 - protein, 9 aa, Artificial Sequence
  Description of Artificial Sequence: Synthetic peptide
  XENP020349 vhCDR3
TGHLGPFDL

SEQ ID NO: 10690 - protein, 215 aa, Artificial Sequence; identical to SEQ ID NO: 9690
  Description of Artificial Sequence: Synthetic polypeptide
  XENP020349 [CTLA-4]_H3.4_L0.126_Fab Light Chain

SEQ ID NO: 10691 - protein, 108 aa, Artificial Sequence; identical to SEQ ID NO: 6742
  Description of Artificial Sequence: Synthetic polypeptide
  VL of XENP020349

SEQ ID NO: 10692 - protein, 12 aa, Artificial Sequence
  Description of Artificial Sequence: Synthetic peptide
  XENP020349 vlCDR1
RASQSVGSSYLA

SEQ ID NO: 10693 - protein, 7 aa, Artificial Sequence
  Description of Artificial Sequence: Synthetic peptide
  XENP020349 vlCDR2
GASSRAT

SEQ ID NO: 10694 - protein, 9 aa, Artificial Sequence
  Description of Artificial Sequence: Synthetic peptide
  XENP020349 vlCDR3
QQYGSSPWT

SEQ ID NO: 10695 - protein, 221 aa, Artificial Sequence; identical to SEQ ID NO: 10385
  Description of Artificial Sequence: Synthetic polypeptide
  XENP020350 [CTLA-4]_H3.4_L0.127_Fab Heavy Chain

SEQ ID NO: 10696 - protein, 118 aa, Artificial Sequence; identical to SEQ ID NO: 7137
  Description of Artificial Sequence: Synthetic polypeptide
  VH of XENP020350

SEQ ID NO: 10697 - protein, 5 aa, Artificial Sequence
  Description of Artificial Sequence: Synthetic peptide
  XENP020350 vhCDR1
SYTMH

SEQ ID NO: 10698 - protein, 17 aa, Artificial Sequence
  Description of Artificial Sequence: Synthetic peptide
  XENP020350 vhCDR2
FISYDGNHKYYADSVKG

SEQ ID NO: 10699 - protein, 9 aa, Artificial Sequence
  Description of Artificial Sequence: Synthetic peptide
  XENP020350 vhCDR3
TGHLGPFDL

SEQ ID NO: 10700 - protein, 215 aa, Artificial Sequence
  Description of Artificial Sequence: Synthetic polypeptide
  XENP020350 [CTLA-4]_H3.4_L0.127_Fab Light Chain
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10701 - protein, 108 aa, Artificial Sequence; identical to SEQ ID NO: 7426
  Description of Artificial Sequence: Synthetic polypeptide
  VL of XENP020350

SEQ ID NO: 10702 - protein, 12 aa, Artificial Sequence
  Description of Artificial Sequence: Synthetic peptide
  XENP020350 vlCDR1
RASQSVSSSYLA

SEQ ID NO: 10703 - protein, 7 aa, Artificial Sequence
  Description of Artificial Sequence: Synthetic peptide
  XENP020350 vlCDR2
GASSRAT

SEQ ID NO: 10704 - protein, 9 aa, Artificial Sequence
  Description of Artificial Sequence: Synthetic peptide
  XENP020350 vlCDR3
QQYGSSPWT

SEQ ID NO: 10705 - protein, 221 aa, Artificial Sequence; identical to SEQ ID NO: 10385
  Description of Artificial Sequence: Synthetic polypeptide
  XENP020351 [CTLA-4]_H3.4_L0.128_Fab Heavy Chain

SEQ ID NO: 10706 - protein, 118 aa, Artificial Sequence; identical to SEQ ID NO: 7137
  Description of Artificial Sequence: Synthetic polypeptide
  VH of XENP020351

SEQ ID NO: 10707 - protein, 5 aa, Artificial Sequence
  Description of Artificial Sequence: Synthetic peptide
  XENP020351 vhCDR1
SYTMH

SEQ ID NO: 10708 - protein, 17 aa, Artificial Sequence
  Description of Artificial Sequence: Synthetic peptide
  XENP020351 vhCDR2
FISYDGNHKYYADSVKG

SEQ ID NO: 10709 - protein, 9 aa, Artificial Sequence
  Description of Artificial Sequence: Synthetic peptide
  XENP020351 vhCDR3
TGHLGPFDL

SEQ ID NO: 10710 - protein, 215 aa, Artificial Sequence
  Description of Artificial Sequence: Synthetic polypeptide
  XENP020351 [CTLA-4]_H3.4_L0.128_Fab Light Chain
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10711 - protein, 108 aa, Artificial Sequence; identical to SEQ ID NO: 7435
  Description of Artificial Sequence: Synthetic polypeptide
  VL of XENP020351

SEQ ID NO: 10712 - protein, 12 aa, Artificial Sequence
  Description of Artificial Sequence: Synthetic peptide
  XENP020351 vlCDR1
RASQSVSSSYLA

SEQ ID NO: 10713 - protein, 7 aa, Artificial Sequence
  Description of Artificial Sequence: Synthetic peptide
  XENP020351 vlCDR2
GAFSRAT

SEQ ID NO: 10714 - protein, 9 aa, Artificial Sequence
  Description of Artificial Sequence: Synthetic peptide
  XENP020351 vlCDR3
QQYGSSPWT

SEQ ID NO: 10715 - protein, 221 aa, Artificial Sequence; identical to SEQ ID NO: 10385
  Description of Artificial Sequence: Synthetic polypeptide
  XENP020352 [CTLA-4]_H3.4_L0.129_Fab Heavy Chain

SEQ ID NO: 10716 - protein, 118 aa, Artificial Sequence; identical to SEQ ID NO: 7137
  Description of Artificial Sequence: Synthetic polypeptide
  VH of XENP020352

SEQ ID NO: 10717 - protein, 5 aa, Artificial Sequence
  Description of Artificial Sequence: Synthetic peptide
  XENP020352 vhCDR1
SYTMH

SEQ ID NO: 10718 - protein, 17 aa, Artificial Sequence
  Description of Artificial Sequence: Synthetic peptide
  XENP020352 vhCDR2
FISYDGNHKYYADSVKG

SEQ ID NO: 10719 - protein, 9 aa, Artificial Sequence
  Description of Artificial Sequence: Synthetic peptide
  XENP020352 vhCDR3
TGHLGPFDL

SEQ ID NO: 10720 - protein, 215 aa, Artificial Sequence
  Description of Artificial Sequence: Synthetic polypeptide
  XENP020352 [CTLA-4]_H3.4_L0.129_Fab Light Chain
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10721 - protein, 108 aa, Artificial Sequence; identical to SEQ ID NO: 2396
  Description of Artificial Sequence: Synthetic polypeptide
  VL of XENP020352

SEQ ID NO: 10722 - protein, 12 aa, Artificial Sequence
  Description of Artificial Sequence: Synthetic peptide
  XENP020352 vlCDR1
RASQSVGSSYLA

SEQ ID NO: 10723 - protein, 7 aa, Artificial Sequence
  Description of Artificial Sequence: Synthetic peptide
  XENP020352 vlCDR2
GASSRAT

SEQ ID NO: 10724 - protein, 9 aa, Artificial Sequence
  Description of Artificial Sequence: Synthetic peptide
  XENP020352 vlCDR3
QQYGSSPWT

SEQ ID NO: 10725 - protein, 221 aa, Artificial Sequence; identical to SEQ ID NO: 10385
  Description of Artificial Sequence: Synthetic polypeptide
  XENP020353 [CTLA-4]_H3.4_L0.130_Fab Heavy Chain

SEQ ID NO: 10726 - protein, 118 aa, Artificial Sequence; identical to SEQ ID NO: 7137
  Description of Artificial Sequence: Synthetic polypeptide
  VH of XENP020353

SEQ ID NO: 10727 - protein, 5 aa, Artificial Sequence
  Description of Artificial Sequence: Synthetic peptide
  XENP020353 vhCDR1
SYTMH

SEQ ID NO: 10728 - protein, 17 aa, Artificial Sequence
  Description of Artificial Sequence: Synthetic peptide
  XENP020353 vhCDR2
FISYDGNHKYYADSVKG

SEQ ID NO: 10729 - protein, 9 aa, Artificial Sequence
  Description of Artificial Sequence: Synthetic peptide
  XENP020353 vhCDR3
TGHLGPFDL

SEQ ID NO: 10730 - protein, 215 aa, Artificial Sequence
  Description of Artificial Sequence: Synthetic polypeptide
  XENP020353 [CTLA-4]_H3.4_L0.130_Fab Light Chain
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10731 - protein, 108 aa, Artificial Sequence; identical to SEQ ID NO: 7453
  Description of Artificial Sequence: Synthetic polypeptide
  VL of XENP020353

SEQ ID NO: 10732 - protein, 12 aa, Artificial Sequence
  Description of Artificial Sequence: Synthetic peptide
  XENP020353 vlCDR1
RASQSVSSSYLA

SEQ ID NO: 10733 - protein, 7 aa, Artificial Sequence
  Description of Artificial Sequence: Synthetic peptide
  XENP020353 vlCDR2
GASSRAT

SEQ ID NO: 10734 - protein, 9 aa, Artificial Sequence
  Description of Artificial Sequence: Synthetic peptide
  XENP020353 vlCDR3
QQYGSSPWT

SEQ ID NO: 10735 - protein, 221 aa, Artificial Sequence; identical to SEQ ID NO: 10385
  Description of Artificial Sequence: Synthetic polypeptide
  XENP020354 [CTLA-4]_H3.4_L0.131_Fab Heavy Chain

SEQ ID NO: 10736 - protein, 118 aa, Artificial Sequence; identical to SEQ ID NO: 7137
  Description of Artificial Sequence: Synthetic polypeptide
  VH of XENP020354

SEQ ID NO: 10737 - protein, 5 aa, Artificial Sequence
  Description of Artificial Sequence: Synthetic peptide
  XENP020354 vhCDR1
SYTMH

SEQ ID NO: 10738 - protein, 17 aa, Artificial Sequence
  Description of Artificial Sequence: Synthetic peptide
  XENP020354 vhCDR2
FISYDGNHKYYADSVKG

SEQ ID NO: 10739 - protein, 9 aa, Artificial Sequence
  Description of Artificial Sequence: Synthetic peptide
  XENP020354 vhCDR3
TGHLGPFDL

SEQ ID NO: 10740 - protein, 215 aa, Artificial Sequence
  Description of Artificial Sequence: Synthetic polypeptide
  XENP020354 [CTLA-4]_H3.4_L0.131_Fab Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10741 - protein, 108 aa, Artificial Sequence; identical to SEQ ID NO: 7462
  Description of Artificial Sequence: Synthetic polypeptide
  VL of XENP020354

SEQ ID NO: 10742 - protein, 12 aa, Artificial Sequence
  Description of Artificial Sequence: Synthetic peptide
  XENP020354 vlCDR1
RASQSVSSSYLA

SEQ ID NO: 10743 - protein, 7 aa, Artificial Sequence
  Description of Artificial Sequence: Synthetic peptide
  XENP020354 vlCDR2
GASSRAT

SEQ ID NO: 10744 - protein, 9 aa, Artificial Sequence
  Description of Artificial Sequence: Synthetic peptide
  XENP020354 vlCDR3
QQYGSSPWT

SEQ ID NO: 10745 - protein, 221 aa, Artificial Sequence; identical to SEQ ID NO: 10385
  Description of Artificial Sequence: Synthetic polypeptide
  XENP020355 [CTLA-4]_H3.4_L0.132_Fab Heavy Chain

SEQ ID NO: 10746 - protein, 118 aa, Artificial Sequence; identical to SEQ ID NO: 7137
  Description of Artificial Sequence: Synthetic polypeptide
  VH of XENP020355

SEQ ID NO: 10747 - protein, 5 aa, Artificial Sequence
  Description of Artificial Sequence: Synthetic peptide
  XENP020355 vhCDR1
SYTMH

SEQ ID NO: 10748 - protein, 17 aa, Artificial Sequence
  Description of Artificial Sequence: Synthetic peptide
  XENP020355 vhCDR2
FISYDGNHKYYADSVKG

SEQ ID NO: 10749 - protein, 9 aa, Artificial Sequence
  Description of Artificial Sequence: Synthetic peptide
  XENP020355 vhCDR3
TGHLGPFDL

SEQ ID NO: 10750 - protein, 215 aa, Artificial Sequence
  Description of Artificial Sequence: Synthetic polypeptide
  XENP020355 [CTLA-4]_H3.4_L0.132_Fab Light Chain
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10751 - protein, 108 aa, Artificial Sequence; identical to SEQ ID NO: 7471
  Description of Artificial Sequence: Synthetic polypeptide
  VL of XENP020355

SEQ ID NO: 10752 - protein, 12 aa, Artificial Sequence
  Description of Artificial Sequence: Synthetic peptide
  XENP020355 vlCDR1
RASQSVSSSYLA

SEQ ID NO: 10753 - protein, 7 aa, Artificial Sequence
  Description of Artificial Sequence: Synthetic peptide
  XENP020355 vlCDR2
GASSRAT

SEQ ID NO: 10754 - protein, 9 aa, Artificial Sequence
  Description of Artificial Sequence: Synthetic peptide
  XENP020355 vlCDR3
QQYGSSPWT

SEQ ID NO: 10755 - protein, 221 aa, Artificial Sequence; identical to SEQ ID NO: 10395
  Description of Artificial Sequence: Synthetic polypeptide
  XENP020356 [CTLA-4]_H3.5_L2_Fab Heavy Chain

SEQ ID NO: 10756 - protein, 118 aa, Artificial Sequence; identical to SEQ ID NO: 7146
  Description of Artificial Sequence: Synthetic polypeptide
  VH of XENP020356

SEQ ID NO: 10757 - protein, 5 aa, Artificial Sequence
  Description of Artificial Sequence: Synthetic peptide
  XENP020356 vhCDR1
SYTMH

SEQ ID NO: 10758 - protein, 17 aa, Artificial Sequence
  Description of Artificial Sequence: Synthetic peptide
  XENP020356 vhCDR2
FISYDGNTKYYADSVKG

SEQ ID NO: 10759 - protein, 9 aa, Artificial Sequence
  Description of Artificial Sequence: Synthetic peptide
  XENP020356 vhCDR3
TGHLGPFDL

SEQ ID NO: 10760 - protein, 215 aa, Artificial Sequence; identical to SEQ ID NO: 10150
  Description of Artificial Sequence: Synthetic polypeptide
  XENP020356 [CTLA-4]_H3.5_L2_Fab Light Chain

SEQ ID NO: 10761 - protein, 108 aa, Artificial Sequence; identical to SEQ ID NO: 4843
  Description of Artificial Sequence: Synthetic polypeptide
  VL of XENP020356

SEQ ID NO: 10762 - protein, 12 aa, Artificial Sequence
  Description of Artificial Sequence: Synthetic peptide
  XENP020356 vlCDR1
RASQSVGSSYLA

SEQ ID NO: 10763 - protein, 7 aa, Artificial Sequence
  Description of Artificial Sequence: Synthetic peptide
  XENP020356 vlCDR2
GAFSRAT

SEQ ID NO: 10764 - protein, 9 aa, Artificial Sequence
  Description of Artificial Sequence: Synthetic peptide
  XENP020356 vlCDR3
QQYGSSPWT

SEQ ID NO: 10765 - protein, 221 aa, Artificial Sequence; identical to SEQ ID NO: 10395
  Description of Artificial Sequence: Synthetic polypeptide
  XENP020357 [CTLA-4]_H3.5_L2.1_Fab Heavy Chain

SEQ ID NO: 10766 - protein, 118 aa, Artificial Sequence; identical to SEQ ID NO: 7146
  Description of Artificial Sequence: Synthetic polypeptide
  VH of XENP020357

SEQ ID NO: 10767 - protein, 5 aa, Artificial Sequence
  Description of Artificial Sequence: Synthetic peptide
  XENP020357 vhCDR1
SYTMH

SEQ ID NO: 10768 - protein, 17 aa, Artificial Sequence
  Description of Artificial Sequence: Synthetic peptide
  XENP020357 vhCDR2
FISYDGNTKYYADSVKG

SEQ ID NO: 10769 - protein, 9 aa, Artificial Sequence
  Description of Artificial Sequence: Synthetic peptide
  XENP020357 vhCDR3
TGHLGPFDL

SEQ ID NO: 10770 - protein, 215 aa, Artificial Sequence
  Description of Artificial Sequence: Synthetic polypeptide
  XENP020357 [CTLA-4]_H3.5_L2.1_Fab Light Chain
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10771 - protein, 108 aa, Artificial Sequence; identical to SEQ ID NO: 7489
  Description of Artificial Sequence: Synthetic polypeptide
  VL of XENP020357

SEQ ID NO: 10772 - protein, 12 aa, Artificial Sequence
  Description of Artificial Sequence: Synthetic peptide
  XENP020357 vlCDR1
RASQSVSSSYLA

SEQ ID NO: 10773 - protein, 7 aa, Artificial Sequence
  Description of Artificial Sequence: Synthetic peptide
  XENP020357 vlCDR2
GAFSRAT

SEQ ID NO: 10774 - protein, 9 aa, Artificial Sequence
  Description of Artificial Sequence: Synthetic peptide
  XENP020357 vlCDR3
QQYGSSPWT

SEQ ID NO: 10775 - protein, 221 aa, Artificial Sequence; identical to SEQ ID NO: 10395
  Description of Artificial Sequence: Synthetic polypeptide
  XENP020358 [CTLA-4]_H3.5_L2.2_Fab Heavy Chain

SEQ ID NO: 10776 - protein, 118 aa, Artificial Sequence; identical to SEQ ID NO: 7146
  Description of Artificial Sequence: Synthetic polypeptide
  VH of XENP020358

SEQ ID NO: 10777 - protein, 5 aa, Artificial Sequence
  Description of Artificial Sequence: Synthetic peptide
  XENP020358 vhCDR1
SYTMH

SEQ ID NO: 10778 - protein, 17 aa, Artificial Sequence
  Description of Artificial Sequence: Synthetic peptide
  XENP020358 vhCDR2
FISYDGNTKYYADSVKG

SEQ ID NO: 10779 - protein, 9 aa, Artificial Sequence
  Description of Artificial Sequence: Synthetic peptide
  XENP020358 vhCDR3
TGHLGPFDL

SEQ ID NO: 10780 - protein, 215 aa, Artificial Sequence
  Description of Artificial Sequence: Synthetic polypeptide
  XENP020358 [CTLA-4]_H3.5_L2.2_Fab Light Chain
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10781 - protein, 108 aa, Artificial Sequence; identical to SEQ ID NO: 7498
  Description of Artificial Sequence: Synthetic polypeptide
  VL of XENP020358

SEQ ID NO: 10782 - protein, 12 aa, Artificial Sequence
  Description of Artificial Sequence: Synthetic peptide
  XENP020358 vlCDR1
RASQSVGSSYLA

SEQ ID NO: 10783 - protein, 7 aa, Artificial Sequence
  Description of Artificial Sequence: Synthetic peptide
  XENP020358 vlCDR2
GASSRAT

SEQ ID NO: 10784 - protein, 9 aa, Artificial Sequence
  Description of Artificial Sequence: Synthetic peptide
  XENP020358 vlCDR3
QQYGSSPWT

SEQ ID NO: 10785 - protein, 221 aa, Artificial Sequence; identical to SEQ ID NO: 10395
  Description of Artificial Sequence: Synthetic polypeptide
  XENP020359 [CTLA-4]_H3.5_L2.3_Fab Heavy Chain

SEQ ID NO: 10786 - protein, 118 aa, Artificial Sequence; identical to SEQ ID NO: 7146
  Description of Artificial Sequence: Synthetic polypeptide
  VH of XENP020359

SEQ ID NO: 10787 - protein, 5 aa, Artificial Sequence
  Description of Artificial Sequence: Synthetic peptide
  XENP020359 vhCDR1
SYTMH

SEQ ID NO: 10788 - protein, 17 aa, Artificial Sequence
  Description of Artificial Sequence: Synthetic peptide
  XENP020359 vhCDR2
FISYDGNTKYYADSVKG

SEQ ID NO: 10789 - protein, 9 aa, Artificial Sequence
  Description of Artificial Sequence: Synthetic peptide
  XENP020359 vhCDR3
TGHLGPFDL

SEQ ID NO: 10790 - protein, 215 aa, Artificial Sequence
  Description of Artificial Sequence: Synthetic polypeptide
  XENP020359 [CTLA-4]_H3.5_L2.3_Fab Light Chain
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10791 - protein, 108 aa, Artificial Sequence; identical to SEQ ID NO: 7507
  Description of Artificial Sequence: Synthetic polypeptide
  VL of XENP020359

SEQ ID NO: 10792 - protein, 12 aa, Artificial Sequence
  Description of Artificial Sequence: Synthetic peptide
  XENP020359 vlCDR1
RASQSVSSSYLA

SEQ ID NO: 10793 - protein, 7 aa, Artificial Sequence
  Description of Artificial Sequence: Synthetic peptide
  XENP020359 vlCDR2
GASSRAT

SEQ ID NO: 10794 - protein, 9 aa, Artificial Sequence
  Description of Artificial Sequence: Synthetic peptide
  XENP020359 vlCDR3
QQYGSSPWT

SEQ ID NO: 10795 - protein, 221 aa, Artificial Sequence; identical to SEQ ID NO: 10545
  Description of Artificial Sequence: Synthetic polypeptide
  XENP020422 [CTLA-4]_H3.21_L0.124_Fab Heavy Chain

SEQ ID NO: 10796 - protein, 118 aa, Artificial Sequence; identical to SEQ ID NO: 7290
  Description of Artificial Sequence: Synthetic polypeptide
  VH of XENP020422

SEQ ID NO: 10797 - protein, 5 aa, Artificial Sequence
  Description of Artificial Sequence: Synthetic peptide
  XENP020422 vhCDR1
SYTMH

SEQ ID NO: 10798 - protein, 17 aa, Artificial Sequence
  Description of Artificial Sequence: Synthetic peptide
  XENP020422 vhCDR2
FISYDGNTKYYADSVKG

SEQ ID NO: 10799 - protein, 9 aa, Artificial Sequence
  Description of Artificial Sequence: Synthetic peptide
  XENP020422 vhCDR3
GGLLGPFDL

SEQ ID NO: 10800 - protein, 215 aa, Artificial Sequence; identical to SEQ ID NO: 10670
  Description of Artificial Sequence: Synthetic polypeptide
  XENP020422 [CTLA-4]_H3.21_L0.124_Fab Light Chain

SEQ ID NO: 10801 - protein, 108 aa, Artificial Sequence; identical to SEQ ID NO: 7399
  Description of Artificial Sequence: Synthetic polypeptide
  VL of XENP020422

SEQ ID NO: 10802 - protein, 12 aa, Artificial Sequence
  Description of Artificial Sequence: Synthetic peptide
  XENP020422 vlCDR1
RASQSVGSSYLA

SEQ ID NO: 10803 - protein, 7 aa, Artificial Sequence
  Description of Artificial Sequence: Synthetic peptide
  XENP020422 vlCDR2
GASSRAT

SEQ ID NO: 10804 - protein, 9 aa, Artificial Sequence
  Description of Artificial Sequence: Synthetic peptide
  XENP020422 vlCDR3
QQYGSSPWT

SEQ ID NO: 10805 - protein, 221 aa, Artificial Sequence; identical to SEQ ID NO: 10545
  Description of Artificial Sequence: Synthetic polypeptide
  XENP020423 [CTLA-4]_H3.21_L0.129_Fab Heavy Chain

SEQ ID NO: 10806 - protein, 118 aa, Artificial Sequence; identical to SEQ ID NO: 7290
  Description of Artificial Sequence: Synthetic polypeptide
  VH of XENP020423

SEQ ID NO: 10807 - protein, 5 aa, Artificial Sequence
  Description of Artificial Sequence: Synthetic peptide
  XENP020423 vhCDR1
SYTMH

SEQ ID NO: 10808 - protein, 17 aa, Artificial Sequence
  Description of Artificial Sequence: Synthetic peptide
  XENP020423 vhCDR2
FISYDGNTKYYADSVKG

SEQ ID NO: 10809 - protein, 9 aa, Artificial Sequence
  Description of Artificial Sequence: Synthetic peptide
  XENP020423 vhCDR3
GGLLGPFDL

SEQ ID NO: 10810 - protein, 215 aa, Artificial Sequence; identical to SEQ ID NO: 10720
  Description of Artificial Sequence: Synthetic polypeptide
  XENP020423 [CTLA-4]_H3.21_L0.129_Fab Light Chain

SEQ ID NO: 10811 - protein, 108 aa, Artificial Sequence; identical to SEQ ID NO: 2396
  Description of Artificial Sequence: Synthetic polypeptide
  VL of XENP020423

SEQ ID NO: 10812 - protein, 12 aa, Artificial Sequence
  Description of Artificial Sequence: Synthetic peptide
  XENP020423 vlCDR1
RASQSVGSSYLA

SEQ ID NO: 10813 - protein, 7 aa, Artificial Sequence
  Description of Artificial Sequence: Synthetic peptide
  XENP020423 vlCDR2
GASSRAT

SEQ ID NO: 10814 - protein, 9 aa, Artificial Sequence
  Description of Artificial Sequence: Synthetic peptide
  XENP020423 vlCDR3
QQYGSSPWT

SEQ ID NO: 10815 - protein, 221 aa, Artificial Sequence; identical to SEQ ID NO: 10545
  Description of Artificial Sequence: Synthetic polypeptide
  XENP020424 [CTLA-4]_H3.21_L0.132_Fab Heavy Chain

SEQ ID NO: 10816 - protein, 118 aa, Artificial Sequence; identical to SEQ ID NO: 7290
  Description of Artificial Sequence: Synthetic polypeptide
  VH of XENP020424

SEQ ID NO: 10817 - protein, 5 aa, Artificial Sequence
  Description of Artificial Sequence: Synthetic peptide
  XENP020424 vhCDR1
SYTMH

SEQ ID NO: 10818 - protein, 17 aa, Artificial Sequence
  Description of Artificial Sequence: Synthetic peptide
  XENP020424 vhCDR2
FISYDGNTKYYADSVKG

SEQ ID NO: 10819 - protein, 9 aa, Artificial Sequence
  Description of Artificial Sequence: Synthetic peptide
  XENP020424 vhCDR3
GGLLGPFDL

SEQ ID NO: 10820 - protein, 215 aa, Artificial Sequence; identical to SEQ ID NO: 10750
  Description of Artificial Sequence: Synthetic polypeptide
  XENP020424 [CTLA-4]_H3.21_L0.132_Fab Light Chain

SEQ ID NO: 10821 - protein, 108 aa, Artificial Sequence; identical to SEQ ID NO: 7471
  Description of Artificial Sequence: Synthetic polypeptide
  VL of XENP020424

SEQ ID NO: 10822 - protein, 12 aa, Artificial Sequence
  Description of Artificial Sequence: Synthetic peptide
  XENP020424 vlCDR1
RASQSVSSSYLA

SEQ ID NO: 10823 - protein, 7 aa, Artificial Sequence
  Description of Artificial Sequence: Synthetic peptide
  XENP020424 vlCDR2
GASSRAT

SEQ ID NO: 10824 - protein, 9 aa, Artificial Sequence
  Description of Artificial Sequence: Synthetic peptide
  XENP020424 vlCDR3
QQYGSSPWT

SEQ ID NO: 10825 - protein, 221 aa, Artificial Sequence; identical to SEQ ID NO: 10565
  Description of Artificial Sequence: Synthetic polypeptide
  XENP020425 [CTLA-4]_H3.23_L0.124_Fab Heavy Chain

SEQ ID NO: 10826 - protein, 118 aa, Artificial Sequence; identical to SEQ ID NO: 2395
  Description of Artificial Sequence: Synthetic polypeptide
  VH of XENP020425

SEQ ID NO: 10827 - protein, 5 aa, Artificial Sequence
  Description of Artificial Sequence: Synthetic peptide
  XENP020425 vhCDR1
SYTMH

SEQ ID NO: 10828 - protein, 17 aa, Artificial Sequence
  Description of Artificial Sequence: Synthetic peptide
  XENP020425 vhCDR2
FISYDGNYKYYADSVKG

SEQ ID NO: 10829 - protein, 9 aa, Artificial Sequence
  Description of Artificial Sequence: Synthetic peptide
  XENP020425 vhCDR3
GGHLGPFDL

SEQ ID NO: 10830 - protein, 215 aa, Artificial Sequence; identical to SEQ ID NO: 10670
  Description of Artificial Sequence: Synthetic polypeptide
  XENP020425 [CTLA-4]_H3.23_L0.124_Fab Light Chain

SEQ ID NO: 10831 - protein, 108 aa, Artificial Sequence; identical to SEQ ID NO: 7399
  Description of Artificial Sequence: Synthetic polypeptide
  VL of XENP020425

SEQ ID NO: 10832 - protein, 12 aa, Artificial Sequence
  Description of Artificial Sequence: Synthetic peptide
  XENP020425 vlCDR1
RASQSVGSSYLA

SEQ ID NO: 10833 - protein, 7 aa, Artificial Sequence
  Description of Artificial Sequence: Synthetic peptide
  XENP020425 vlCDR2
GASSRAT

SEQ ID NO: 10834 - protein, 9 aa, Artificial Sequence
  Description of Artificial Sequence: Synthetic peptide
  XENP020425 vlCDR3
QQYGSSPWT

SEQ ID NO: 10835 - protein, 221 aa, Artificial Sequence; identical to SEQ ID NO: 10565
  Description of Artificial Sequence: Synthetic polypeptide
  XENP020426 [CTLA-4]_H3.23_L0.129_Fab Heavy Chain

SEQ ID NO: 10836 - protein, 118 aa, Artificial Sequence; identical to SEQ ID NO: 2395
  Description of Artificial Sequence: Synthetic polypeptide
  VH of XENP020426

SEQ ID NO: 10837 - protein, 5 aa, Artificial Sequence
  Description of Artificial Sequence: Synthetic peptide
  XENP020426 vhCDR1
SYTMH

SEQ ID NO: 10838 - protein, 17 aa, Artificial Sequence
  Description of Artificial Sequence: Synthetic peptide
  XENP020426 vhCDR2
FISYDGNYKYYADSVKG

SEQ ID NO: 10839 - protein, 9 aa, Artificial Sequence
  Description of Artificial Sequence: Synthetic peptide
  XENP020426 vhCDR3
GGHLGPFDL

SEQ ID NO: 10840 - protein, 215 aa, Artificial Sequence; identical to SEQ ID NO: 10720
  Description of Artificial Sequence: Synthetic polypeptide
  XENP020426 [CTLA-4]_H3.23_L0.129_Fab Light Chain

SEQ ID NO: 10841 - protein, 108 aa, Artificial Sequence; identical to SEQ ID NO: 2396
  Description of Artificial Sequence: Synthetic polypeptide
  VL of XENP020426

SEQ ID NO: 10842 - protein, 12 aa, Artificial Sequence
  Description of Artificial Sequence: Synthetic peptide
  XENP020426 vlCDR1
RASQSVGSSYLA

SEQ ID NO: 10843 - protein, 7 aa, Artificial Sequence
  Description of Artificial Sequence: Synthetic peptide
  XENP020426 vlCDR2
GASSRAT

SEQ ID NO: 10844 - protein, 9 aa, Artificial Sequence
  Description of Artificial Sequence: Synthetic peptide
  XENP020426 vlCDR3
QQYGSSPWT

SEQ ID NO: 10845 - protein, 221 aa, Artificial Sequence; identical to SEQ ID NO: 10565
  Description of Artificial Sequence: Synthetic polypeptide
  XENP020427 [CTLA-4]_H3.23_L0.132_Fab Heavy Chain

SEQ ID NO: 10846 - protein, 118 aa, Artificial Sequence; identical to SEQ ID NO: 2395
  Description of Artificial Sequence: Synthetic polypeptide
  VH of XENP020427

SEQ ID NO: 10847 - protein, 5 aa, Artificial Sequence
  Description of Artificial Sequence: Synthetic peptide
  XENP020427 vhCDR1
SYTMH

SEQ ID NO: 10848 - protein, 17 aa, Artificial Sequence
  Description of Artificial Sequence: Synthetic peptide
  XENP020427 vhCDR2
FISYDGNYKYYADSVKG

SEQ ID NO: 10849 - protein, 9 aa, Artificial Sequence
  Description of Artificial Sequence: Synthetic peptide
  XENP020427 vhCDR3
GGHLGPFDL

SEQ ID NO: 10850 - protein, 215 aa, Artificial Sequence; identical to SEQ ID NO: 10750
  Description of Artificial Sequence: Synthetic polypeptide
  XENP020427 [CTLA-4]_H3.23_L0.132_Fab Light Chain

SEQ ID NO: 10851 - protein, 108 aa, Artificial Sequence; identical to SEQ ID NO: 7471
  Description of Artificial Sequence: Synthetic polypeptide
  VL of XENP020427

SEQ ID NO: 10852 - protein, 12 aa, Artificial Sequence
  Description of Artificial Sequence: Synthetic peptide
  XENP020427 vlCDR1
RASQSVSSSYLA

SEQ ID NO: 10853 - protein, 7 aa, Artificial Sequence
  Description of Artificial Sequence: Synthetic peptide
  XENP020427 vlCDR2
GASSRAT

SEQ ID NO: 10854 - protein, 9 aa, Artificial Sequence
  Description of Artificial Sequence: Synthetic peptide
  XENP020427 vlCDR3
QQYGSSPWT

SEQ ID NO: 10855 - protein, 221 aa, Artificial Sequence; identical to SEQ ID NO: 10585
  Description of Artificial Sequence: Synthetic polypeptide
  XENP020428 [CTLA-4]_H3.25_L0.124_Fab Heavy Chain

SEQ ID NO: 10856 - protein, 118 aa, Artificial Sequence; identical to SEQ ID NO: 7326
  Description of Artificial Sequence: Synthetic polypeptide
  VH of XENP020428

SEQ ID NO: 10857 - protein, 5 aa, Artificial Sequence
  Description of Artificial Sequence: Synthetic peptide
  XENP020428 vhCDR1
SYTMH

SEQ ID NO: 10858 - protein, 17 aa, Artificial Sequence
  Description of Artificial Sequence: Synthetic peptide
  XENP020428 vhCDR2
FISYDGNYKYYADSVKG

SEQ ID NO: 10859 - protein, 9 aa, Artificial Sequence
  Description of Artificial Sequence: Synthetic peptide
  XENP020428 vhCDR3
GGLLGPFDL

SEQ ID NO: 10860 - protein, 215 aa, Artificial Sequence; identical to SEQ ID NO: 10670
  Description of Artificial Sequence: Synthetic polypeptide
  XENP020428 [CTLA-4]_H3.25_L0.124_Fab Light Chain

SEQ ID NO: 10861 - protein, 108 aa, Artificial Sequence; identical to SEQ ID NO: 7399
  Description of Artificial Sequence: Synthetic polypeptide
  VL of XENP020428

SEQ ID NO: 10862 - protein, 12 aa, Artificial Sequence
  Description of Artificial Sequence: Synthetic peptide
  XENP020428 vlCDR1
RASQSVGSSYLA

SEQ ID NO: 10863 - protein, 7 aa, Artificial Sequence
  Description of Artificial Sequence: Synthetic peptide
  XENP020428 vlCDR2
GASSRAT

SEQ ID NO: 10864 - protein, 9 aa, Artificial Sequence
  Description of Artificial Sequence: Synthetic peptide
  XENP020428 vlCDR3
QQYGSSPWT

SEQ ID NO: 10865 - protein, 221 aa, Artificial Sequence; identical to SEQ ID NO: 10585
  Description of Artificial Sequence: Synthetic polypeptide
  XENP020429 [CTLA-4]_H3.25_L0.129_Fab Heavy Chain

SEQ ID NO: 10866 - protein, 118 aa, Artificial Sequence; identical to SEQ ID NO: 7326
  Description of Artificial Sequence: Synthetic polypeptide
  VH of XENP020429

SEQ ID NO: 10867 - protein, 5 aa, Artificial Sequence
  Description of Artificial Sequence: Synthetic peptide
  XENP020429 vhCDR1
SYTMH

SEQ ID NO: 10868 - protein, 17 aa, Artificial Sequence
  Description of Artificial Sequence: Synthetic peptide
  XENP020429 vhCDR2
FISYDGNYKYYADSVKG

SEQ ID NO: 10869 - protein, 9 aa, Artificial Sequence
  Description of Artificial Sequence: Synthetic peptide
  XENP020429 vhCDR3
GGLLGPFDL

SEQ ID NO: 10870 - protein, 215 aa, Artificial Sequence; identical to SEQ ID NO: 10720
  Description of Artificial Sequence: Synthetic polypeptide
  XENP020429 [CTLA-4]_H3.25_L0.129_Fab Light Chain

SEQ ID NO: 10871 - protein, 108 aa, Artificial Sequence; identical to SEQ ID NO: 2396
  Description of Artificial Sequence: Synthetic polypeptide
  VL of XENP020429

SEQ ID NO: 10872 - protein, 12 aa, Artificial Sequence
  Description of Artificial Sequence: Synthetic peptide
  XENP020429 vlCDR1
RASQSVGSSYLA

SEQ ID NO: 10873 - protein, 7 aa, Artificial Sequence
  Description of Artificial Sequence: Synthetic peptide
  XENP020429 vlCDR2
GASSRAT

SEQ ID NO: 10874 - protein, 9 aa, Artificial Sequence
  Description of Artificial Sequence: Synthetic peptide
  XENP020429 vlCDR3
QQYGSSPWT

SEQ ID NO: 10875 - protein, 221 aa, Artificial Sequence; identical to SEQ ID NO: 10585
  Description of Artificial Sequence: Synthetic polypeptide
  XENP020430 [CTLA-4]_H3.25_L0.132_Fab Heavy Chain

SEQ ID NO: 10876 - protein, 118 aa, Artificial Sequence; identical to SEQ ID NO: 7326
  Description of Artificial Sequence: Synthetic polypeptide
  VH of XENP020430

SEQ ID NO: 10877 - protein, 5 aa, Artificial Sequence
  Description of Artificial Sequence: Synthetic peptide
  XENP020430 vhCDR1
SYTMH

SEQ ID NO: 10878 - protein, 17 aa, Artificial Sequence
  Description of Artificial Sequence: Synthetic peptide
  XENP020430 vhCDR2
FISYDGNYKYYADSVKG

SEQ ID NO: 10879 - protein, 9 aa, Artificial Sequence
  Description of Artificial Sequence: Synthetic peptide
  XENP020430 vhCDR3
GGLLGPFDL

SEQ ID NO: 10880 - protein, 215 aa, Artificial Sequence; identical to SEQ ID NO: 10750
  Description of Artificial Sequence: Synthetic polypeptide
  XENP020430 [CTLA-4]_H3.25_L0.132_Fab Light Chain

SEQ ID NO: 10881 - protein, 108 aa, Artificial Sequence; identical to SEQ ID NO: 7471
  Description of Artificial Sequence: Synthetic polypeptide
  VL of XENP020430

SEQ ID NO: 10882 - protein, 12 aa, Artificial Sequence
  Description of Artificial Sequence: Synthetic peptide
  XENP020430 vlCDR1
RASQSVSSSYLA

SEQ ID NO: 10883 - protein, 7 aa, Artificial Sequence
  Description of Artificial Sequence: Synthetic peptide
  XENP020430 vlCDR2
GASSRAT

SEQ ID NO: 10884 - protein, 9 aa, Artificial Sequence
  Description of Artificial Sequence: Synthetic peptide
  XENP020430 vlCDR3
QQYGSSPWT

SEQ ID NO: 10885 - protein, 240 aa, Artificial Sequence
  Description of Artificial Sequence: Synthetic polypeptide
  XENP016402 nivolumab_H0.1_L0_scFv(GKPGS)4
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 10886 - protein, 113 aa, Artificial Sequence
  Description of Artificial Sequence: Synthetic polypeptide
  VH of XENP016402
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 10887 - protein, 107 aa, Artificial Sequence [sequence omitted]

SEQ ID NO: 10888 - protein, 5 aa, Artificial Sequence
  Description of Artificial Sequence: Synthetic peptide
  XENP016402 vhCDR1
NSGMH

SEQ ID NO: 10889 - protein, 17 aa, Artificial Sequence
  Description of Artificial Sequence: Synthetic peptide
  XENP016402 vhCDR2
VIWYDGSKRYYADSVKG

SEQ ID NO: 10890 - protein, 4 aa, Artificial Sequence
  Description of Artificial Sequence: Synthetic peptide
  XENP016402 vhCDR3
NDDY

SEQ ID NO: 10891 - protein, 11 aa, Artificial Sequence
  Description of Artificial Sequence: Synthetic peptide
  XENP016402 vlCDR1
RASQSVSSYLA

SEQ ID NO: 10892 - protein, 7 aa, Artificial Sequence
  Description of Artificial Sequence: Synthetic peptide
  XENP016402 vlCDR2
DASNRAT

SEQ ID NO: 10893 - protein, 9 aa, Artificial Sequence
  Description of Artificial Sequence: Synthetic peptide
  XENP016402 vlCDR3
QQSSNWPRT

SEQ ID NO: 10894 - protein, 246 aa, Artificial Sequence
  Description of Artificial Sequence: Synthetic polypeptide
  XENP017919 1A2_H1L1_scFv(GKPGS)4
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSGKPGSGKPGSGKPGSGKPGSDLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 10895 - protein, 114 aa, Artificial Sequence
  Description of Artificial Sequence: Synthetic polypeptide
  VH of XENP017919
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSS

SEQ ID NO: 10896 - protein, 112 aa, Artificial Sequence
  Description of Artificial Sequence: Synthetic polypeptide
  VL of XENP017919
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 10897 - protein, 5 aa, Artificial Sequence
  Description of Artificial Sequence: Synthetic peptide
  XENP017919 vhCDR1
DYSMH

SEQ ID NO: 10898 - protein, 17 aa, Artificial Sequence
  Description of Artificial Sequence: Synthetic peptide
  XENP017919 vhCDR2
WINTETGEPTYADKFQG

SEQ ID NO: 10899 - protein, 5 aa, Artificial Sequence
  Description of Artificial Sequence: Synthetic peptide
  XENP017919 vhCDR3
SPLDY

SEQ ID NO: 10900 - protein, 16 aa, Artificial Sequence
  Description of Artificial Sequence: Synthetic peptide
  XENP017919 vlCDR1
RSSQSIVHSNGNTYLE

SEQ ID NO: 10901 - protein, 7 aa, Artificial Sequence
  Description of Artificial Sequence: Synthetic peptide
  XENP017919 vlCDR2
KVFNRFS

SEQ ID NO: 10902 - protein, 9 aa, Artificial Sequence
  Description of Artificial Sequence: Synthetic peptide
  XENP017919 vlCDR3
FQGSHVPFT

SEQ ID NO: 10903 - protein, 251 aa, Artificial Sequence
  Description of Artificial Sequence: Synthetic polypeptide
  XENP017920 1C7_H1L1_scFv(GKPGS)4
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSGKPGSGKPGSGKPGSGKPGSDIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 10904 - protein, 120 aa, Artificial Sequence
  Description of Artificial Sequence: Synthetic polypeptide
  VH of XENP017920
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSS

SEQ ID NO: 10905 - protein, 111 aa, Artificial Sequence
  Description of Artificial Sequence: Synthetic polypeptide
  VL of XENP017920
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 10906 - protein, 5 aa, Artificial Sequence
  Description of Artificial Sequence: Synthetic peptide
  XENP017920 vhCDR1
SYDMS

SEQ ID NO: 10907 - protein, 17 aa, Artificial Sequence
  Description of Artificial Sequence: Synthetic peptide
  XENP017920 vhCDR2
YISSGGGSTYYPDSVKG

SEQ ID NO: 10908 - protein, 11 aa, Artificial Sequence
  Description of Artificial Sequence: Synthetic peptide
  XENP017920 vhCDR3
PLDDYYAPFAY

SEQ ID NO: 10909 - protein, 15 aa, Artificial Sequence
  Description of Artificial Sequence: Synthetic peptide
  XENP017920 vlCDR1
RASESVDNDGISFMN

SEQ ID NO: 10910 - protein, 7 aa, Artificial Sequence
  Description of Artificial Sequence: Synthetic peptide
  XENP017920 vlCDR2
AASNQGS

SEQ ID NO: 10911 - protein, 9 aa, Artificial Sequence
  Description of Artificial Sequence: Synthetic peptide
  XENP017920 vlCDR3
QQSKEVPWT

SEQ ID NO: 10912 - protein, 246 aa, Artificial Sequence
  Description of Artificial Sequence: Synthetic polypeptide
  XENP017921 1G2_H1L1_scFv(GKPGS)4
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSGKPGSGKPGSGKPGSGKPGSDIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 10913 - protein, 114 aa, Artificial Sequence
  Description of Artificial Sequence: Synthetic polypeptide
  VH of XENP017921
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSS

SEQ ID NO: 10914 - protein, 112 aa, Artificial Sequence
  Description of Artificial Sequence: Synthetic polypeptide
  VL of XENP017921
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 10915 - protein, 5 aa, Artificial Sequence
  Description of Artificial Sequence: Synthetic peptide
  XENP017921 vhCDR1
DYGVN

SEQ ID NO: 10916 - protein, 16 aa, Artificial Sequence
  Description of Artificial Sequence: Synthetic peptide
  XENP017921 vhCDR2
MIWGDGSTDYNSKFQG

SEQ ID NO: 10917 - protein, 6 aa, Artificial Sequence
  Description of Artificial Sequence: Synthetic peptide
  XENP017921 vhCDR3
EYAMDY

SEQ ID NO: 10918 - protein, 17 aa, Artificial Sequence
  Description of Artificial Sequence: Synthetic peptide
  XENP017921 vlCDR1
KSSQSLLNSRTRKNYLA

SEQ ID NO: 10919 - protein, 7 aa, Artificial Sequence
  Description of Artificial Sequence: Synthetic peptide
  XENP017921 vlCDR2
WASTRES

SEQ ID NO: 10920 - protein, 8 aa, Artificial Sequence
  Description of Artificial Sequence: Synthetic peptide
  XENP017921 vlCDR3
KQSYNLRT

SEQ ID NO: 10921 - protein, 249 aa, Artificial Sequence
  Description of Artificial Sequence: Synthetic polypeptide
  XENP017922 1G6_H1L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10922 - protein, 122 aa, Artificial Sequence
  Description of Artificial Sequence: Synthetic polypeptide
  VH of XENP017922
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10923 - protein, 107 aa, Artificial Sequence
  Description of Artificial Sequence: Synthetic polypeptide
  VL of XENP017922
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10924 - protein, 5 aa, Artificial Sequence
  Description of Artificial Sequence: Synthetic peptide
  XENP017922 vhCDR1
NYWMN

SEQ ID NO: 10925 - protein, 19 aa, Artificial Sequence
  Description of Artificial Sequence: Synthetic peptide
  XENP017922 vhCDR2
EIRLKSNNYATHYAEPVKG

SEQ ID NO: 10926 - protein, 11 aa, Artificial Sequence
  Description of Artificial Sequence: Synthetic peptide
  XENP017922 vhCDR3
YYGNYGGYFDV

SEQ ID NO: 10927 - protein, 11 aa, Artificial Sequence
  Description of Artificial Sequence: Synthetic peptide
  XENP017922 vlCDR1
RASQSVSNDVA

SEQ ID NO: 10928 - protein, 7 aa, Artificial Sequence
  Description of Artificial Sequence: Synthetic peptide
  XENP017922 vlCDR2
YASHRYT

SEQ ID NO: 10929 - protein, 9 aa, Artificial Sequence
  Description of Artificial Sequence: Synthetic peptide
  XENP017922 vlCDR3
QQDYSSPRT

SEQ ID NO: 10930 - protein, 249 aa, Artificial Sequence
  Description of Artificial Sequence: Synthetic polypeptide
  XENP017923 1G6_H1L2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 10931 - protein, 122 aa, Artificial Sequence; identical to SEQ ID NO: 10922
  Description of Artificial Sequence: Synthetic polypeptide
  VH of XENP017923

SEQ ID NO: 10932 - protein, 107 aa, Artificial Sequence
  Description of Artificial Sequence: Synthetic polypeptide
  VL of XENP017923
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 10933 - protein, 5 aa, Artificial Sequence
  Description of Artificial Sequence: Synthetic peptide
  XENP017923 vhCDR1
NYWMN

SEQ ID NO: 10934 - protein, 19 aa, Artificial Sequence
  Description of Artificial Sequence: Synthetic peptide
  XENP017923 vhCDR2
EIRLKSNNYATHYAEPVKG

SEQ ID NO: 10935 - protein, 11 aa, Artificial Sequence
  Description of Artificial Sequence: Synthetic peptide
  XENP017923 vhCDR3
YYGNYGGYFDV

SEQ ID NO: 10936 - protein, 11 aa, Artificial Sequence
  Description of Artificial Sequence: Synthetic peptide
  XENP017923 vlCDR1
RASQSVSNDVA

SEQ ID NO: 10937 - protein, 7 aa, Artificial Sequence
  Description of Artificial Sequence: Synthetic peptide
  XENP017923 vlCDR2
YASHRYT

SEQ ID NO: 10938 - protein, 9 aa, Artificial Sequence
  Description of Artificial Sequence: Synthetic peptide
  XENP017923 vlCDR3
QQDYSSPRT

SEQ ID NO: 10939 - protein, 242 aa, Artificial Sequence
  Description of Artificial Sequence: Synthetic polypeptide
  XENP017924 2A2_H1L1_scFv(GKPGS)4
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSGKPGSGKPGSGKPGSGKPGSDIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 10940 - protein, 115 aa, Artificial Sequence
  Description of Artificial Sequence: Synthetic polypeptide
  VH of XENP017924
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSS

SEQ ID NO: 10941 - protein, 107 aa, Artificial Sequence
  Description of Artificial Sequence: Synthetic polypeptide
  VL of XENP017924
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 10942 - protein, 5 aa, Artificial Sequence
  Description of Artificial Sequence: Synthetic peptide
  XENP017924 vhCDR1
NYWMH

SEQ ID NO: 10943 - protein, 17 aa, Artificial Sequence
  Description of Artificial Sequence: Synthetic peptide
  XENP017924 vhCDR2
YINPSTGYTEYNQKFQG

SEQ ID NO: 10944 - protein, 6 aa, Artificial Sequence
  Description of Artificial Sequence: Synthetic peptide
  XENP017924 vhCDR3
GNYFAY

SEQ ID NO: 10945 - protein, 11 aa, Artificial Sequence
  Description of Artificial Sequence: Synthetic peptide
  XENP017924 vlCDR1
RPSESLYSYLA

SEQ ID NO: 10946 - protein, 7 aa, Artificial Sequence
  Description of Artificial Sequence: Synthetic peptide
  XENP017924 vlCDR2
NAKTLVE

SEQ ID NO: 10947 - protein, 9 aa, Artificial Sequence
  Description of Artificial Sequence: Synthetic peptide
  XENP017924 vlCDR3
QHHYGTPFT

SEQ ID NO: 10948 - protein, 252 aa, Artificial Sequence
  Description of Artificial Sequence: Synthetic polypeptide
  XENP017925 2F11_H1L1_scFv(GKPGS)4
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSGKPGSGKPGSGKPGSGKPGSDVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 10949 - protein, 120 aa, Artificial Sequence
  Description of Artificial Sequence: Synthetic polypeptide
  VH of XENP017925
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSS

SEQ ID NO: 10950 - protein, 112 aa, Artificial Sequence
  Description of Artificial Sequence: Synthetic polypeptide
  VL of XENP017925
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 10951 - protein, 5 aa, Artificial Sequence
  Description of Artificial Sequence: Synthetic peptide
  XENP017925 vhCDR1
DYVMH

SEQ ID NO: 10952 - protein, 17 aa, Artificial Sequence
  Description of Artificial Sequence: Synthetic peptide
  XENP017925 vhCDR2
VISTYYGDASYNQKFQG

SEQ ID NO: 10953 - protein, 11 aa, Artificial Sequence
  Description of Artificial Sequence: Synthetic peptide
  XENP017925 vhCDR3
EGYDGYLYFDV

SEQ ID NO: 10954 - protein, 16 aa, Artificial Sequence
  Description of Artificial Sequence: Synthetic peptide
  XENP017925 vlCDR1
RSSQSIVHSNGNTYLE

SEQ ID NO: 10955 - protein, 7 aa, Artificial Sequence
  Description of Artificial Sequence: Synthetic peptide
  XENP017925 vlCDR2
KVSNRFS

SEQ ID NO: 10956 - protein, 9 aa, Artificial Sequence
  Description of Artificial Sequence: Synthetic peptide
  XENP017925 vlCDR3
FQGSHVPYT

SEQ ID NO: 10957 - protein, 252 aa, Artificial Sequence
  Description of Artificial Sequence: Synthetic polypeptide
  XENP017926 5H1_H1L1_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 10958 - protein, 120 aa, Artificial Sequence
  Description of Artificial Sequence: Synthetic polypeptide
  VH of XENP017926
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSS

SEQ ID NO: 10959 - protein, 112 aa, Artificial Sequence
  Description of Artificial Sequence: Synthetic polypeptide
  VL of XENP017926
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 10960 - protein, 5 aa, Artificial Sequence
  Description of Artificial Sequence: Synthetic peptide
  XENP017926 vhCDR1
DYVMH

SEQ ID NO: 10961 - protein, 17 aa, Artificial Sequence
  Description of Artificial Sequence: Synthetic peptide
  XENP017926 vhCDR2
VISIHYGDGRYNQKFQG

SEQ ID NO: 10962 - protein, 11 aa, Artificial Sequence
  Description of Artificial Sequence: Synthetic peptide
  XENP017926 vhCDR3
EVYDGYLYFDV

SEQ ID NO: 10963 - protein, 16 aa, Artificial Sequence
  Description of Artificial Sequence: Synthetic peptide
  XENP017926 vlCDR1
RSSQSIVHSNGNTYLE

SEQ ID NO: 10964 - protein, 7 aa, Artificial Sequence
  Description of Artificial Sequence: Synthetic peptide
  XENP017926 vlCDR2
KVSNRFS

SEQ ID NO: 10965 - protein, 9 aa, Artificial Sequence
  Description of Artificial Sequence: Synthetic peptide
  XENP017926 vlCDR3
FQGSHVPYT

SEQ ID NO: 10966 - protein, 252 aa, Artificial Sequence
  Description of Artificial Sequence: Synthetic polypeptide
  XENP017927 5H1_H1L2_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 10967 - protein, 120 aa, Artificial Sequence; identical to SEQ ID NO: 10958
  Description of Artificial Sequence: Synthetic polypeptide
  VH of XENP017927

SEQ ID NO: 10968 - protein, 112 aa, Artificial Sequence
  Description of Artificial Sequence: Synthetic polypeptide
  VL of XENP017927
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 10969 - protein, 5 aa, Artificial Sequence
  Description of Artificial Sequence: Synthetic peptide
  XENP017927 vhCDR1
DYVMH

SEQ ID NO: 10970 - protein, 17 aa, Artificial Sequence
  Description of Artificial Sequence: Synthetic peptide
  XENP017927 vhCDR2
VISIHYGDGRYNQKFQG

SEQ ID NO: 10971 - protein, 11 aa, Artificial Sequence
  Description of Artificial Sequence: Synthetic peptide
  XENP017927 vhCDR3
EVYDGYLYFDV

SEQ ID NO: 10972 - protein, 16 aa, Artificial Sequence
  Description of Artificial Sequence: Synthetic peptide
  XENP017927 vlCDR1
RSSQSIVHSNGNTYLE

SEQ ID NO: 10973 - protein, 7 aa, Artificial Sequence
  Description of Artificial Sequence: Synthetic peptide
  XENP017927 vlCDR2
KVSNRFS

SEQ ID NO: 10974 - protein, 9 aa, Artificial Sequence
  Description of Artificial Sequence: Synthetic peptide
  XENP017927 vlCDR3
FQGSHVPYT

SEQ ID NO: 10975 - protein, 247 aa, Artificial Sequence
  Description of Artificial Sequence: Synthetic polypeptide
  XENP017928 10E4_H1L1_scFv(GKPGS)4
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSGKPGSGKPGSGKPGSGKPGSDIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 10976 - protein, 120 aa, Artificial Sequence
  Description of Artificial Sequence: Synthetic polypeptide
  VH of XENP017928
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSS

SEQ ID NO: 10977 - protein, 107 aa, Artificial Sequence
  Description of Artificial Sequence: Synthetic polypeptide
  VL of XENP017928
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 10978 - protein, 5 aa, Artificial Sequence
  Description of Artificial Sequence: Synthetic peptide
  XENP017928 vhCDR1
SYWMH

SEQ ID NO: 10979 - protein, 17 aa, Artificial Sequence
  Description of Artificial Sequence: Synthetic peptide
  XENP017928 vhCDR2
AIYPGNSDTSYNQKFQG

SEQ ID NO: 10980 - protein, 11 aa, Artificial Sequence
  Description of Artificial Sequence: Synthetic peptide
  XENP017928 vhCDR3
DGNYVRYYFDY

SEQ ID NO: 10981 - protein, 11 aa, Artificial Sequence
  Description of Artificial Sequence: Synthetic peptide
  XENP017928 vlCDR1
RASQDIGSNLN

SEQ ID NO: 10982 - protein, 7 aa, Artificial Sequence
  Description of Artificial Sequence: Synthetic peptide
  XENP017928 vlCDR2
ATSNLDS

SEQ ID NO: 10983 - protein, 9 aa, Artificial Sequence
  Description of Artificial Sequence: Synthetic peptide
  XENP017928 vlCDR3
LQYASSPLT

SEQ ID NO: 10984 - protein, 247 aa, Artificial Sequence
  Description of Artificial Sequence: Synthetic polypeptide
  XENP017929 4C11_H1L1_scFv(GKPGS)4
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSGKPGSGKPGSGKPGSGKPGSDIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 10985 - protein, 120 aa, Artificial Sequence
  Description of Artificial Sequence: Synthetic polypeptide
  VH of XENP017929
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSS

SEQ ID NO: 10986 - protein, 107 aa, Artificial Sequence
  Description of Artificial Sequence: Synthetic polypeptide
  VL of XENP017929
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 10987 - protein, 5 aa, Artificial Sequence
  Description of Artificial Sequence: Synthetic peptide
  XENP017929 vhCDR1
SYWMH

SEQ ID NO: 10988 - protein, 17 aa, Artificial Sequence
  Description of Artificial Sequence: Synthetic peptide
  XENP017929 vhCDR2
AIYPGNSDTSYNQKFQG

SEQ ID NO: 10989 - protein, 11 aa, Artificial Sequence
  Description of Artificial Sequence: Synthetic peptide
  XENP017929 vhCDR3
LYYGSSFAMDY

SEQ ID NO: 10990 - protein, 11 aa, Artificial Sequence
  Description of Artificial Sequence: Synthetic peptide
  XENP017929 vlCDR1
RASQDINTYLS

SEQ ID NO: 10991 - protein, 7 aa, Artificial Sequence
  Description of Artificial Sequence: Synthetic peptide
  XENP017929 vlCDR2
RANRLVD

SEQ ID NO: 10992 - protein, 9 aa, Artificial Sequence
  Description of Artificial Sequence: Synthetic peptide
  XENP017929 vlCDR3
LHYDDFPYT

SEQ ID NO: 10993 - protein, 244 aa, Artificial Sequence
  Description of Artificial Sequence: Synthetic polypeptide
  XENP017930 6A3_H1L1_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 10994 - protein, 117 aa, Artificial Sequence
  Description of Artificial Sequence: Synthetic polypeptide
  VH of XENP017930
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSS

SEQ ID NO: 10995 - protein, 107 aa, Artificial Sequence
  Description of Artificial Sequence: Synthetic polypeptide
  VL of XENP017930
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 10996 - protein, 5 aa, Artificial Sequence
  Description of Artificial Sequence: Synthetic peptide
  XENP017930 vhCDR1
SYGMS

SEQ ID NO: 10997 - protein, 17 aa, Artificial Sequence
  Description of Artificial Sequence: Synthetic peptide
  XENP017930 vhCDR2
TISGGGRYTYYPDSVKG

SEQ ID NO: 10998 - protein, 8 aa, Artificial Sequence
  Description of Artificial Sequence: Synthetic peptide
  XENP017930 vhCDR3
YYDSSFDY

SEQ ID NO: 10999 - protein, 11 aa, Artificial Sequence
  Description of Artificial Sequence: Synthetic peptide
  XENP017930 vlCDR1
KASQDVGTAVA

SEQ ID NO: 11000 - protein, 7 aa, Artificial Sequence
  Description of Artificial Sequence: Synthetic peptide
  XENP017930 vlCDR2
WASTRHT

SEQ ID NO: 11001 - protein, 9 aa, Artificial Sequence
  Description of Artificial Sequence: Synthetic peptide
  XENP017930 vlCDR3
QHYSIYPWT

SEQ ID NO: 11002 - protein, 244 aa, Artificial Sequence
  Description of Artificial Sequence: Synthetic polypeptide
  XENP017931 6A3_H1L2_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 11003 - protein, 117 aa, Artificial Sequence; identical to SEQ ID NO: 10994
  Description of Artificial Sequence: Synthetic polypeptide
  VH of XENP017931

SEQ ID NO: 11004 - protein, 107 aa, Artificial Sequence
  Description of Artificial Sequence: Synthetic polypeptide
  VL of XENP017931
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 11005 - protein, 5 aa, Artificial Sequence
  Description of Artificial Sequence: Synthetic peptide
  XENP017931 vhCDR1
SYGMS

SEQ ID NO: 11006 - protein, 17 aa, Artificial Sequence
  Description of Artificial Sequence: Synthetic peptide
  XENP017931 vhCDR2
TISGGGRYTYYPDSVKG

SEQ ID NO: 11007 - protein, 8 aa, Artificial Sequence
  Description of Artificial Sequence: Synthetic peptide
  XENP017931 vhCDR3
YYDSSFDY

SEQ ID NO: 11008 - protein, 11 aa, Artificial Sequence
  Description of Artificial Sequence: Synthetic peptide
  XENP017931 vlCDR1
RASQDVGTAVA

SEQ ID NO: 11009 - protein, 7 aa, Artificial Sequence
  Description of Artificial Sequence: Synthetic peptide
  XENP017931 vlCDR2
WASTRHT

SEQ ID NO: 11010 - protein, 9 aa, Artificial Sequence
  Description of Artificial Sequence: Synthetic peptide
  XENP017931 vlCDR3
QHYSIYPWT

SEQ ID NO: 11011 - protein, 244 aa, Artificial Sequence
  Description of Artificial Sequence: Synthetic polypeptide
  XENP017932 6A3_H1L3_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 11012 - protein, 117 aa, Artificial Sequence; identical to SEQ ID NO: 10994
  Description of Artificial Sequence: Synthetic polypeptide
  VH of XENP017932

SEQ ID NO: 11013 - protein, 107 aa, Artificial Sequence
  Description of Artificial Sequence: Synthetic polypeptide
  VL of XENP017932
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 11014 - protein, 5 aa, Artificial Sequence
  Description of Artificial Sequence: Synthetic peptide
  XENP017932 vhCDR1
SYGMS

SEQ ID NO: 11015 - protein, 17 aa, Artificial Sequence
  Description of Artificial Sequence: Synthetic peptide
  XENP017932 vhCDR2
TISGGGRYTYYPDSVKG

SEQ ID NO: 11016 - protein, 8 aa, Artificial Sequence
  Description of Artificial Sequence: Synthetic peptide
  XENP017932 vhCDR3
YYDSSFDY

SEQ ID NO: 11017 - protein, 11 aa, Artificial Sequence
  Description of Artificial Sequence: Synthetic peptide
  XENP017932 vlCDR1
RASQDVGTAVA

SEQ ID NO: 11018 - protein, 7 aa, Artificial Sequence
  Description of Artificial Sequence: Synthetic peptide
  XENP017932 vlCDR2
WASTRHT

SEQ ID NO: 11019 - protein, 9 aa, Artificial Sequence
  Description of Artificial Sequence: Synthetic peptide
  XENP017932 vlCDR3
QHYSIYPWT

SEQ ID NO: 11020 - protein, 244 aa, Artificial Sequence
  Description of Artificial Sequence: Synthetic polypeptide
  XENP017933 6A3_H2L3_scFv(GKPGS)4
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 11021 - protein, 117 aa, Artificial Sequence
  Description of Artificial Sequence: Synthetic polypeptide
  VH of XENP017933
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSS

SEQ ID NO: 11022 - protein, 107 aa, Artificial Sequence; identical to SEQ ID NO: 11013
  Description of Artificial Sequence: Synthetic polypeptide
  VL of XENP017933

SEQ ID NO: 11023 - protein, 5 aa, Artificial Sequence
  Description of Artificial Sequence: Synthetic peptide
  XENP017933 vhCDR1
SYGMS

SEQ ID NO: 11024 - protein, 17 aa, Artificial Sequence
  Description of Artificial Sequence: Synthetic peptide
  XENP017933 vhCDR2
TISGGGRYTYYPDSVKG

SEQ ID NO: 11025 - protein, 8 aa, Artificial Sequence
  Description of Artificial Sequence: Synthetic peptide
  XENP017933 vhCDR3
YYDSSFDY

SEQ ID NO: 11026 - protein, 11 aa, Artificial Sequence
  Description of Artificial Sequence: Synthetic peptide
  XENP017933 vlCDR1
RASQDVGTAVA

SEQ ID NO: 11027 - protein, 7 aa, Artificial Sequence
  Description of Artificial Sequence: Synthetic peptide
  XENP017933 vlCDR2
WASTRHT

SEQ ID NO: 11028 - protein, 9 aa, Artificial Sequence
  Description of Artificial Sequence: Synthetic peptide
  XENP017933 vlCDR3
QHYSIYPWT

SEQ ID NO: 11029 - protein, 244 aa, Artificial Sequence
  Description of Artificial Sequence: Synthetic polypeptide
  XENP017934 6A3_H1.1_L3_scFv(GKPGS)4
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 11030 - protein, 117 aa, Artificial Sequence
  Description of Artificial Sequence: Synthetic polypeptide
  VH of XENP017934
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 11031 - protein, 107 aa, Artificial Sequence; identical to SEQ ID NO: 11013
  Description of Artificial Sequence: Synthetic polypeptide
  VL of XENP017934

SEQ ID NO: 11032 - protein, 5 aa, Artificial Sequence
  Description of Artificial Sequence: Synthetic peptide
  XENP017934 vhCDR1
SYGMS

SEQ ID NO: 11033 - protein, 17 aa, Artificial Sequence
  Description of Artificial Sequence: Synthetic peptide
  XENP017934 vhCDR2
TISGGGRYTYYPDSVKG

SEQ ID NO: 11034 - protein, 8 aa, Artificial Sequence
  Description of Artificial Sequence: Synthetic peptide
  XENP017934 vhCDR3
YYDSSFDY

SEQ ID NO: 11035 - protein, 11 aa, Artificial Sequence
  Description of Artificial Sequence: Synthetic peptide
  XENP017934 vlCDR1
RASQDVGTAVA

SEQ ID NO: 11036 - protein, 7 aa, Artificial Sequence
  Description of Artificial Sequence: Synthetic peptide
  XENP017934 vlCDR2
WASTRHT

SEQ ID NO: 11037 - protein, 9 aa, Artificial Sequence
  Description of Artificial Sequence: Synthetic peptide
  XENP017934 vlCDR3
QHYSIYPWT

SEQ ID NO: 11038 - protein, 249 aa, Artificial Sequence
  Description of Artificial Sequence: Synthetic polypeptide
  XENP018493 1G6_H1.1_L1_scFv(GKPGS)4
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11039 - protein, 122 aa, Artificial Sequence
  Description of Artificial Sequence: Synthetic polypeptide
  VH of XENP018493
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11040 - protein, 107 aa, Artificial Sequence; identical to SEQ ID NO: 10923
  Description of Artificial Sequence: Synthetic polypeptide
  VL of XENP018493

SEQ ID NO: 11041 - protein, 5 aa, Artificial Sequence
  Description of Artificial Sequence: Synthetic peptide
  XENP018493 vhCDR1
NYWMN

SEQ ID NO: 11042 - protein, 19 aa, Artificial Sequence
  Description of Artificial Sequence: Synthetic peptide
  XENP018493 vhCDR2
EIRLKSNNYATHYAEPVKG

SEQ ID NO: 11043 - protein, 11 aa, Artificial Sequence
  Description of Artificial Sequence: Synthetic peptide
  XENP018493 vhCDR3
YYGNYGGYFDV

SEQ ID NO: 11044 - protein, 11 aa, Artificial Sequence
  Description of Artificial Sequence: Synthetic peptide
  XENP018493 vlCDR1
RASQSVSNDVA

SEQ ID NO: 11045 - protein, 7 aa, Artificial Sequence
  Description of Artificial Sequence: Synthetic peptide
  XENP018493 vlCDR2
YASHRYT

SEQ ID NO: 11046 - protein, 9 aa, Artificial Sequence
  Description of Artificial Sequence: Synthetic peptide
  XENP018493 vlCDR3
QQDYSSPRT

SEQ ID NO: 11047 - protein, 249 aa, Artificial Sequence
  Description of Artificial Sequence: Synthetic polypeptide
  XENP018494 1G6_H1.2_L1_scFv(GKPGS)4
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11048 - protein, 122 aa, Artificial Sequence
  Description of Artificial Sequence: Synthetic polypeptide
  VH of XENP018494
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11049 - protein, 107 aa, Artificial Sequence; identical to SEQ ID NO: 10923
  Description of Artificial Sequence: Synthetic polypeptide
  VL of XENP018494

SEQ ID NO: 11050 - protein, 5 aa, Artificial Sequence
  Description of Artificial Sequence: Synthetic peptide
  XENP018494 vhCDR1
NYWMN

SEQ ID NO: 11051 - protein, 19 aa, Artificial Sequence
  Description of Artificial Sequence: Synthetic peptide
  XENP018494 vhCDR2
EIRLKSNNYATHYAEPVKG

SEQ ID NO: 11052 - protein, 11 aa, Artificial Sequence
  Description of Artificial Sequence: Synthetic peptide
  XENP018494 vhCDR3
YYGNYGGYFDV

SEQ ID NO: 11053 - protein, 11 aa, Artificial Sequence
  Description of Artificial Sequence: Synthetic peptide
  XENP018494 vlCDR1
RASQSVSNDVA

SEQ ID NO: 11054 - protein, 7 aa, Artificial Sequence
  Description of Artificial Sequence: Synthetic peptide
  XENP018494 vlCDR2
YASHRYT

SEQ ID NO: 11055 - protein, 9 aa, Artificial Sequence
  Description of Artificial Sequence: Synthetic peptide
  XENP018494 vlCDR3
QQDYSSPRT

SEQ ID NO: 11056 - protein, 249 aa, Artificial Sequence
  Description of Artificial Sequence: Synthetic polypeptide
  XENP018495 1G6_H1.3_L1_scFv(GKPGS)4
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11057 - protein, 122 aa, Artificial Sequence
  Description of Artificial Sequence: Synthetic polypeptide
  VH of XENP018495
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11058 - protein, 107 aa, Artificial Sequence; identical to SEQ ID NO: 10923
  Description of Artificial Sequence: Synthetic polypeptide
  VL of XENP018495

SEQ ID NO: 11059 - protein, 5 aa, Artificial Sequence
  Description of Artificial Sequence: Synthetic peptide
  XENP018495 vhCDR1
NYWMN

SEQ ID NO: 11060 - protein, 19 aa, Artificial Sequence
  Description of Artificial Sequence: Synthetic peptide
  XENP018495 vhCDR2
EIRLKSNNYATHYAEPVKG

SEQ ID NO: 11061 - protein, 11 aa, Artificial Sequence
  Description of Artificial Sequence: Synthetic peptide
  XENP018495 vhCDR3
YYGNYGGYFDV

SEQ ID NO: 11062 - protein, 11 aa, Artificial Sequence
  Description of Artificial Sequence: Synthetic peptide
  XENP018495 vlCDR1
RASQSVSNDVA

SEQ ID NO: 11063 - protein, 7 aa, Artificial Sequence
  Description of Artificial Sequence: Synthetic peptide
  XENP018495 vlCDR2
YASHRYT

SEQ ID NO: 11064 - protein, 9 aa, Artificial Sequence
  Description of Artificial Sequence: Synthetic peptide
  XENP018495 vlCDR3
QQDYSSPRT

SEQ ID NO: 11065 - protein, 249 aa, Artificial Sequence
  Description of Artificial Sequence: Synthetic polypeptide
  XENP018496 1G6_H1.4_L1_scFv(GKPGS)4
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11066 - protein, 122 aa, Artificial Sequence
  Description of Artificial Sequence: Synthetic polypeptide
  VH of XENP018496
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11067 - protein, 107 aa, Artificial Sequence; identical to SEQ ID NO: 10923
  Description of Artificial Sequence: Synthetic polypeptide
  VL of XENP018496

SEQ ID NO: 11068 - protein, 5 aa, Artificial Sequence
  Description of Artificial Sequence: Synthetic peptide
  XENP018496 vhCDR1
NYWMN

SEQ ID NO: 11069 - protein, 19 aa, Artificial Sequence
  Description of Artificial Sequence: Synthetic peptide
  XENP018496 vhCDR2
EIRLKSNNYATHYAEPVKG

SEQ ID NO: 11070 - protein, 11 aa, Artificial Sequence
  Description of Artificial Sequence: Synthetic peptide
  XENP018496 vhCDR3
YYGNYGGYFDV

SEQ ID NO: 11071 - protein, 11 aa, Artificial Sequence
  Description of Artificial Sequence: Synthetic peptide
  XENP018496 vlCDR1
RASQSVSNDVA

SEQ ID NO: 11072 - protein, 7 aa, Artificial Sequence
  Description of Artificial Sequence: Synthetic peptide
  XENP018496 vlCDR2
YASHRYT

SEQ ID NO: 11073 - protein, 9 aa, Artificial Sequence
  Description of Artificial Sequence: Synthetic peptide
  XENP018496 vlCDR3
QQDYSSPRT

SEQ ID NO: 11074 - protein, 249 aa, Artificial Sequence
  Description of Artificial Sequence: Synthetic polypeptide
  XENP018501 1G6_H1.5_L1_scFv(GKPGS)4
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11075 - protein, 122 aa, Artificial Sequence
  Description of Artificial Sequence: Synthetic polypeptide
  VH of XENP018501
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11076 - protein, 107 aa, Artificial Sequence; identical to SEQ ID NO: 10923
  Description of Artificial Sequence: Synthetic polypeptide
  VL of XENP018501

SEQ ID NO: 11077 - protein, 5 aa, Artificial Sequence
  Description of Artificial Sequence: Synthetic peptide
  XENP018501 vhCDR1
NYWMN

SEQ ID NO: 11078 - protein, 19 aa, Artificial Sequence
  Description of Artificial Sequence: Synthetic peptide
  XENP018501 vhCDR2
EIRLKSNNYATHYAEPVKG

SEQ ID NO: 11079 - protein, 11 aa, Artificial Sequence
  Description of Artificial Sequence: Synthetic peptide
  XENP018501 vhCDR3
YYGNYGGYFDV

SEQ ID NO: 11080 - protein, 11 aa, Artificial Sequence
  Description of Artificial Sequence: Synthetic peptide
  XENP018501 vlCDR1
RASQSVSNDVA

SEQ ID NO: 11081 - protein, 7 aa, Artificial Sequence
  Description of Artificial Sequence: Synthetic peptide
  XENP018501 vlCDR2
YASHRYT

SEQ ID NO: 11082 - protein, 9 aa, Artificial Sequence
  Description of Artificial Sequence: Synthetic peptide
  XENP018501 vlCDR3
QQDYSSPRT

SEQ ID NO: 11083 - protein, 249 aa, Artificial Sequence
  Description of Artificial Sequence: Synthetic polypeptide
  XENP018502 1G6_H1.6_L1_scFv(GKPGS)4
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11084 - protein, 122 aa, Artificial Sequence
  Description of Artificial Sequence: Synthetic polypeptide
  VH of XENP018502
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11085 - protein, 107 aa, Artificial Sequence; identical to SEQ ID NO: 10923
  Description of Artificial Sequence: Synthetic polypeptide
  VL of XENP018502

SEQ ID NO: 11086 - protein, 5 aa, Artificial Sequence
  Description of Artificial Sequence: Synthetic peptide
  XENP018502 vhCDR1
NYWMN

SEQ ID NO: 11087 - protein, 19 aa, Artificial Sequence
  Description of Artificial Sequence: Synthetic peptide
  XENP018502 vhCDR2
EIRLKSNNYATHYAEPVKG

SEQ ID NO: 11088 - protein, 11 aa, Artificial Sequence
  Description of Artificial Sequence: Synthetic peptide
  XENP018502 vhCDR3
YYGNYGGYFDV

SEQ ID NO: 11089 - protein, 11 aa, Artificial Sequence
  Description of Artificial Sequence: Synthetic peptide
  XENP018502 vlCDR1
RASQSVSNDVA

SEQ ID NO: 11090 - protein, 7 aa, Artificial Sequence
  Description of Artificial Sequence: Synthetic peptide
  XENP018502 vlCDR2
YASHRYT

SEQ ID NO: 11091 - protein, 9 aa, Artificial Sequence
  Description of Artificial Sequence: Synthetic peptide
  XENP018502 vlCDR3
QQDYSSPRT

SEQ ID NO: 11092 - protein, 249 aa, Artificial Sequence
  Description of Artificial Sequence: Synthetic polypeptide
  XENP018503 1G6_H1.7_L1_scFv(GKPGS)4
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11093 - protein, 122 aa, Artificial Sequence
  Description of Artificial Sequence: Synthetic polypeptide
  VH of XENP018503
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11094 - protein, 107 aa, Artificial Sequence; identical to SEQ ID NO: 10923
  Description of Artificial Sequence: Synthetic polypeptide
  VL of XENP018503

SEQ ID NO: 11095 - protein, 5 aa, Artificial Sequence
  Description of Artificial Sequence: Synthetic peptide
  XENP018503 vhCDR1
NYWMN

SEQ ID NO: 11096 - protein, 19 aa, Artificial Sequence
  Description of Artificial Sequence: Synthetic peptide
  XENP018503 vhCDR2
EIRLKSNNYATHYAEPVKG

SEQ ID NO: 11097 - protein, 11 aa, Artificial Sequence
  Description of Artificial Sequence: Synthetic peptide
  XENP018503 vhCDR3
YYGNYGGYFDV

SEQ ID NO: 11098 - protein, 11 aa, Artificial Sequence
  Description of Artificial Sequence: Synthetic peptide
  XENP018503 vlCDR1
RASQSVSNDVA

SEQ ID NO: 11099 - protein, 7 aa, Artificial Sequence
  Description of Artificial Sequence: Synthetic peptide
  XENP018503 vlCDR2
YASHRYT

SEQ ID NO: 11100 - protein, 9 aa, Artificial Sequence
  Description of Artificial Sequence: Synthetic peptide
  XENP018503 vlCDR3
QQDYSSPRT

SEQ ID NO: 11101 - protein, 249 aa, Artificial Sequence
  Description of Artificial Sequence: Synthetic polypeptide
  XENP018504 1G6_H1.8_L1_scFv(GKPGS)4
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11102 - protein, 122 aa, Artificial Sequence
  Description of Artificial Sequence: Synthetic polypeptide
  VH of XENP018504
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11103 - protein, 107 aa, Artificial Sequence; identical to SEQ ID NO: 10923
  Description of Artificial Sequence: Synthetic polypeptide
  VL of XENP018504

SEQ ID NO: 11104 - protein, 5 aa, Artificial Sequence
  Description of Artificial Sequence: Synthetic peptide
  XENP018504 vhCDR1
NYWMN

SEQ ID NO: 11105 - protein, 19 aa, Artificial Sequence
  Description of Artificial Sequence: Synthetic peptide
  XENP018504 vhCDR2
EIRLKSNNYATHYAEPVKG

SEQ ID NO: 11106 - protein, 11 aa, Artificial Sequence
  Description of Artificial Sequence: Synthetic peptide
  XENP018504 vhCDR3
YYGNYGGYFDV

SEQ ID NO: 11107 - protein, 11 aa, Artificial Sequence
  Description of Artificial Sequence: Synthetic peptide
  XENP018504 vlCDR1
RASQSVSNDVA

SEQ ID NO: 11108 - protein, 7 aa, Artificial Sequence
  Description of Artificial Sequence: Synthetic peptide
  XENP018504 vlCDR2
YASHRYT

SEQ ID NO: 11109 - protein, 9 aa, Artificial Sequence
  Description of Artificial Sequence: Synthetic peptide
  XENP018504 vlCDR3
QQDYSSPRT

SEQ ID NO: 11110 - protein, 249 aa, Artificial Sequence
  Description of Artificial Sequence: Synthetic polypeptide
  XENP018505 1G6_H1.9_L1_scFv(GKPGS)4
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11111 - protein, 122 aa, Artificial Sequence
  Description of Artificial Sequence: Synthetic polypeptide
  VH of XENP018505
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11112 - protein, 107 aa, Artificial Sequence; identical to SEQ ID NO: 10923
  Description of Artificial Sequence: Synthetic polypeptide
  VL of XENP018505

SEQ ID NO: 11113 - protein, 5 aa, Artificial Sequence
  Description of Artificial Sequence: Synthetic peptide
  XENP018505 vhCDR1
NYWMN

SEQ ID NO: 11114 - protein, 19 aa, Artificial Sequence
  Description of Artificial Sequence: Synthetic peptide
  XENP018505 vhCDR2
EIRLKSNNYATHYAEPVKG

SEQ ID NO: 11115 - protein, 11 aa, Artificial Sequence
  Description of Artificial Sequence: Synthetic peptide
  XENP018505 vhCDR3
YYGNYGGYFDV

SEQ ID NO: 11116 - protein, 11 aa, Artificial Sequence
  Description of Artificial Sequence: Synthetic peptide
  XENP018505 vlCDR1
RASQSVSNDVA

SEQ ID NO: 11117 - protein, 7 aa, Artificial Sequence
  Description of Artificial Sequence: Synthetic peptide
  XENP018505 vlCDR2
YASHRYT

SEQ ID NO: 11118 - protein, 9 aa, Artificial Sequence
  Description of Artificial Sequence: Synthetic peptide
  XENP018505 vlCDR3
QQDYSSPRT

SEQ ID NO: 11119 - protein, 249 aa, Artificial Sequence
  Description of Artificial Sequence: Synthetic polypeptide
  XENP018506 1G6_H1.10_L1_scFv(GKPGS)4
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11120 - protein, 122 aa, Artificial Sequence
  Description of Artificial Sequence: Synthetic polypeptide
  VH of XENP018506
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11121 - protein, 107 aa, Artificial Sequence; identical to SEQ ID NO: 10923
  Description of Artificial Sequence: Synthetic polypeptide
  VL of XENP018506

SEQ ID NO: 11122 - protein, 5 aa, Artificial Sequence
  Description of Artificial Sequence: Synthetic peptide
  XENP018506 vhCDR1
NYWMN

SEQ ID NO: 11123 - protein, 19 aa, Artificial Sequence
  Description of Artificial Sequence: Synthetic peptide
  XENP018506 vhCDR2
EIRLKSNNYATHYAEPVKG

SEQ ID NO: 11124 - protein, 11 aa, Artificial Sequence
  Description of Artificial Sequence: Synthetic peptide
  XENP018506 vhCDR3
YYGNYGGYFDV

SEQ ID NO: 11125 - protein, 11 aa, Artificial Sequence
  Description of Artificial Sequence: Synthetic peptide
  XENP018506 vlCDR1
RASQSVSNDVA

SEQ ID NO: 11126 - protein, 7 aa, Artificial Sequence
  Description of Artificial Sequence: Synthetic peptide
  XENP018506 vlCDR2
YASHRYT

SEQ ID NO: 11127 - protein, 9 aa, Artificial Sequence
  Description of Artificial Sequence: Synthetic peptide
  XENP018506 vlCDR3
QQDYSSPRT

SEQ ID NO: 11128 - protein, 249 aa, Artificial Sequence
  Description of Artificial Sequence: Synthetic polypeptide
  XENP018507 1G6_H1.11_L1_scFv(GKPGS)4
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11129 - protein, 122 aa, Artificial Sequence
  Description of Artificial Sequence: Synthetic polypeptide
  VH of XENP018507
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11130 - protein, 107 aa, Artificial Sequence; identical to SEQ ID NO: 10923
  Description of Artificial Sequence: Synthetic polypeptide
  VL of XENP018507

SEQ ID NO: 11131 - protein, 5 aa, Artificial Sequence
  Description of Artificial Sequence: Synthetic peptide
  XENP018507 vhCDR1
NYWMN

SEQ ID NO: 11132 - protein, 19 aa, Artificial Sequence
  Description of Artificial Sequence: Synthetic peptide
  XENP018507 vhCDR2
EIRLKSNNYATHYAEPVKG

SEQ ID NO: 11133 - protein, 11 aa, Artificial Sequence
  Description of Artificial Sequence: Synthetic peptide
  XENP018507 vhCDR3
YYGNYGGYFDV

SEQ ID NO: 11134 - protein, 11 aa, Artificial Sequence
  Description of Artificial Sequence: Synthetic peptide
  XENP018507 vlCDR1
RASQSVSNDVA

SEQ ID NO: 11135 - protein, 7 aa, Artificial Sequence
  Description of Artificial Sequence: Synthetic peptide
  XENP018507 vlCDR2
YASHRYT

SEQ ID NO: 11136 - protein, 9 aa, Artificial Sequence
  Description of Artificial Sequence: Synthetic peptide
  XENP018507 vlCDR3
QQDYSSPRT

SEQ ID NO: 11137 - protein, 249 aa, Artificial Sequence
  Description of Artificial Sequence: Synthetic polypeptide
  XENP018508 1G6_H1.12_L1_scFv(GKPGS)4
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11138 - protein, 122 aa, Artificial Sequence
  Description of Artificial Sequence: Synthetic polypeptide
  VH of XENP018508
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11139 - protein, 107 aa, Artificial Sequence; identical to SEQ ID NO: 10923
  Description of Artificial Sequence: Synthetic polypeptide
  VL of XENP018508

SEQ ID NO: 11140 - protein, 5 aa, Artificial Sequence
  Description of Artificial Sequence: Synthetic peptide
  XENP018508 vhCDR1
NYWMN

SEQ ID NO: 11141 - protein, 19 aa, Artificial Sequence
  Description of Artificial Sequence: Synthetic peptide
  XENP018508 vhCDR2
EIRLKSNNYATHYAEPVKG

SEQ ID NO: 11142 - protein, 11 aa, Artificial Sequence
  Description of Artificial Sequence: Synthetic peptide
  XENP018508 vhCDR3
YYGNYGGYFDV

SEQ ID NO: 11143 - protein, 11 aa, Artificial Sequence
  Description of Artificial Sequence: Synthetic peptide
  XENP018508 vlCDR1
RASQSVSNDVA

SEQ ID NO: 11144 - protein, 7 aa, Artificial Sequence
  Description of Artificial Sequence: Synthetic peptide
  XENP018508 vlCDR2
YASHRYT

SEQ ID NO: 11145 - protein, 9 aa, Artificial Sequence
  Description of Artificial Sequence: Synthetic peptide
  XENP018508 vlCDR3
QQDYSSPRT

SEQ ID NO: 11146 - protein, 249 aa, Artificial Sequence
  Description of Artificial Sequence: Synthetic polypeptide
  XENP018509 1G6_H1.13_L1_scFv(GKPGS)4
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11147 - protein, 122 aa, Artificial Sequence
  Description of Artificial Sequence: Synthetic polypeptide
  VH of XENP018509
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11148 - protein, 107 aa, Artificial Sequence; identical to SEQ ID NO: 10923
  Description of Artificial Sequence: Synthetic polypeptide
  VL of XENP018509

SEQ ID NO: 11149 - protein, 5 aa, Artificial Sequence
  Description of Artificial Sequence: Synthetic peptide
  XENP018509 vhCDR1
NYWMN

SEQ ID NO: 11150 - protein, 19 aa, Artificial Sequence
  Description of Artificial Sequence: Synthetic peptide
  XENP018509 vhCDR2
EIRLKSNNYATHYAEPVKG

SEQ ID NO: 11151 - protein, 11 aa, Artificial Sequence
  Description of Artificial Sequence: Synthetic peptide
  XENP018509 vhCDR3
YYGNYGGYFDV

SEQ ID NO: 11152 - protein, 11 aa, Artificial Sequence
  Description of Artificial Sequence: Synthetic peptide
  XENP018509 vlCDR1
RASQSVSNDVA

SEQ ID NO: 11153 - protein, 7 aa, Artificial Sequence
  Description of Artificial Sequence: Synthetic peptide
  XENP018509 vlCDR2
YASHRYT

SEQ ID NO: 11154 - protein, 9 aa, Artificial Sequence
  Description of Artificial Sequence: Synthetic peptide
  XENP018509 vlCDR3
QQDYSSPRT

SEQ ID NO: 11155 - protein, 249 aa, Artificial Sequence
  Description of Artificial Sequence: Synthetic polypeptide
  XENP018510 1G6_H1.14_L1_scFv(GKPGS)4
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11156 - protein, 122 aa, Artificial Sequence
  Description of Artificial Sequence: Synthetic polypeptide
  VH of XENP018510
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11157 - protein, 107 aa, Artificial Sequence; identical to SEQ ID NO: 10923
  Description of Artificial Sequence: Synthetic polypeptide
  VL of XENP018510

SEQ ID NO: 11158 - protein, 5 aa, Artificial Sequence
  Description of Artificial Sequence: Synthetic peptide
  XENP018510 vhCDR1
NYWMN

SEQ ID NO: 11159 - protein, 19 aa, Artificial Sequence
  Description of Artificial Sequence: Synthetic peptide
  XENP018510 vhCDR2
EIRLKSNNYATHYAEPVKG

SEQ ID NO: 11160 - protein, 11 aa, Artificial Sequence
  Description of Artificial Sequence: Synthetic peptide
  XENP018510 vhCDR3
YYGNYGGYFDV

SEQ ID NO: 11161 - protein, 11 aa, Artificial Sequence
  Description of Artificial Sequence: Synthetic peptide
  XENP018510 vlCDR1
RASQSVSNDVA

SEQ ID NO: 11162 - protein, 7 aa, Artificial Sequence
  Description of Artificial Sequence: Synthetic peptide
  XENP018510 vlCDR2
YASHRYT

SEQ ID NO: 11163 - protein, 9 aa, Artificial Sequence
  Description of Artificial Sequence: Synthetic peptide
  XENP018510 vlCDR3
QQDYSSPRT

SEQ ID NO: 11164 - protein, 249 aa, Artificial Sequence
  Description of Artificial Sequence: Synthetic polypeptide
  XENP018511 1G6_H1.15_L1_scFv(GKPGS)4
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11165 - protein, 122 aa, Artificial Sequence
  Description of Artificial Sequence: Synthetic polypeptide
  VH of XENP018511
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11166 - protein, 107 aa, Artificial Sequence; identical to SEQ ID NO: 10923
  Description of Artificial Sequence: Synthetic polypeptide
  VL of XENP018511

SEQ ID NO: 11167 - protein, 5 aa, Artificial Sequence
  Description of Artificial Sequence: Synthetic peptide
  XENP018511 vhCDR1
NYWMN

SEQ ID NO: 11168 - protein, 19 aa, Artificial Sequence
  Description of Artificial Sequence: Synthetic peptide
  XENP018511 vhCDR2
EIRLKSNNYATHYAEPVKG

SEQ ID NO: 11169 - protein, 11 aa, Artificial Sequence
  Description of Artificial Sequence: Synthetic peptide
  XENP018511 vhCDR3
YYGNYGGYFDV

SEQ ID NO: 11170 - protein, 11 aa, Artificial Sequence
  Description of Artificial Sequence: Synthetic peptide
  XENP018511 vlCDR1
RASQSVSNDVA

SEQ ID NO: 11171 - protein, 7 aa, Artificial Sequence
  Description of Artificial Sequence: Synthetic peptide
  XENP018511 vlCDR2
YASHRYT

SEQ ID NO: 11172 - protein, 9 aa, Artificial Sequence
  Description of Artificial Sequence: Synthetic peptide
  XENP018511 vlCDR3
QQDYSSPRT

SEQ ID NO: 11173 - protein, 249 aa, Artificial Sequence
  Description of Artificial Sequence: Synthetic polypeptide
  XENP018512 1G6_H1.16_L1_scFv(GKPGS)4
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11174 - protein, 122 aa, Artificial Sequence
  Description of Artificial Sequence: Synthetic polypeptide
  VH of XENP018512
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11175 - protein, 107 aa, Artificial Sequence; identical to SEQ ID NO: 10923
  Description of Artificial Sequence: Synthetic polypeptide
  VL of XENP018512

SEQ ID NO: 11176 - protein, 5 aa, Artificial Sequence
  Description of Artificial Sequence: Synthetic peptide
  XENP018512 vhCDR1
NYWMN

SEQ ID NO: 11177 - protein, 19 aa, Artificial Sequence
  Description of Artificial Sequence: Synthetic peptide
  XENP018512 vhCDR2
EIRLKSNNYATHYAEPVKG

SEQ ID NO: 11178 - protein, 11 aa, Artificial Sequence
  Description of Artificial Sequence: Synthetic peptide
  XENP018512 vhCDR3
YYGNYGGYFDV

SEQ ID NO: 11179 - protein, 11 aa, Artificial Sequence
  Description of Artificial Sequence: Synthetic peptide
  XENP018512 vlCDR1
RASQSVSNDVA

SEQ ID NO: 11180 - protein, 7 aa, Artificial Sequence
  Description of Artificial Sequence: Synthetic peptide
  XENP018512 vlCDR2
YASHRYT

SEQ ID NO: 11181 - protein, 9 aa, Artificial Sequence
  Description of Artificial Sequence: Synthetic peptide
  XENP018512 vlCDR3
QQDYSSPRT

(The sequence listing continues in the following parts.)

The invention claimed is:

1. A composition comprising an ICOS binding domain, the ICOS binding domain comprising:
   a) a variable heavy domain having the amino acid sequence of SEQ ID NO: 29562; and
   b) a variable light domain having the amino acid sequence of SEQ ID NO: 29567.

2. A nucleic acid composition comprising:
   a) a first nucleic acid encoding the variable heavy domain of claim 1; and
   b) a second nucleic acid encoding the variable light domain of claim 1.

3. An expression vector comprising the first nucleic acid and second nucleic acid of claim 2.

4. An expression vector composition comprising:
   a) a first expression vector comprising the first nucleic acid of claim 2; and
   b) a second expression vector comprising the second nucleic acid of claim 2.

5. A host cell comprising the expression vector of claim 3 or the expression vector composition of claim 4.

6. A method of making an ICOS binding domain comprising culturing the host cell of claim 5 under conditions wherein the ICOS binding domain is expressed, and recovering the ICOS binding domain.

* * * * *